US008455716B2

(12) United States Patent
Huang et al.

(10) Patent No.: US 8,455,716 B2
(45) Date of Patent: Jun. 4, 2013

(54) MULTIPLE VIRUS RESISTANCE IN PLANTS

(75) Inventors: Shihshieh Huang, Stonington, CT (US); Stanislaw Flasinski, Chesterfield, MO (US); Alessandra Frizzi, Davis, CA (US); Brad Gabor, Woodland, CA (US); Charles Hagen, Davis, CA (US); John Kao, Davis, CA (US); Raquel Salati, Hollister, CA (US)

(73) Assignee: Monsanto Technology LLC, St. Louis, MO (US)

( * ) Notice: Subject to any disclaimer, the term of this patent is extended or adjusted under 35 U.S.C. 154(b) by 97 days.

(21) Appl. No.: 12/763,790

(22) Filed: Apr. 20, 2010

(65) Prior Publication Data
US 2010/0269224 A1 Oct. 21, 2010

Related U.S. Application Data

(60) Provisional application No. 61/171,021, filed on Apr. 20, 2009.

(51) Int. Cl.
*C12N 15/82* (2006.01)
*C12N 15/113* (2010.01)
*C12N 5/10* (2006.01)
*A01H 5/00* (2006.01)

(52) U.S. Cl.
USPC ........ 800/279; 800/285; 800/317.4; 536/24.5

(58) Field of Classification Search
USPC ................................................ 800/285, 279
See application file for complete search history.

(56) References Cited

U.S. PATENT DOCUMENTS

| 5,107,065 A | 4/1992 | Shewmaker et al. |
| 5,453,566 A | 9/1995 | Shewmaker et al. |
| 5,759,829 A | 6/1998 | Shewmaker et al. |
| 6,852,907 B1 | 2/2005 | Padidam et al. |
| 2002/0059660 A1 | 5/2002 | Tricoli et al. |
| 2004/0068764 A1 | 4/2004 | Chu et al. |

FOREIGN PATENT DOCUMENTS

| CN | 1252102 A | 5/2000 |
| WO | WO 98/37223 | 8/1998 |

OTHER PUBLICATIONS

Bucher et al. Multiple virus resistnace at a high frequency using a single transgene construct (2006) J. of Gen. Virol. 87: 3697-3701.*
Qu et al. Artificial microRNA-mediated virus resistance in plants (2007) J. of Virol. 81: 6690-6699.*
Rudolph et al. Peptide-mediated broad-spectrun plant resistance to tospovirises (2003) PNAS 100: 4429-4434.*
Yang et al. Use of tomato yellow leaf curl virus (TYLCV) Rep gene sequences to engineer TYLCV resistance in tomato (2004) Virology 94: 490-496.*
Gubba et al. Combining transgenic and natural resistance to obtain broad resistance to tospovirus infection in tomato (*Lycoperisicon esculentum* mill) (2002) Molec. Breed. 9: 13-23.*
Ramesh et al. Hairpin RNA-mediated strategies for silencing of tomato leaf curl virus AC1 and AC4 genes for effective resistance in plants (2007) Oligonucleotides 17: 251-257.*
Sekine et al. Enhanced resistance to cucumber mosaic virus in the *Artabidopsis thaliana* ssi2 mutant is mediated via an SA-independent mechanism (2004) Molec. Plant-Microbe Inter. 17: 632-632.*
Zamore et al. Ancient pathways programmed by small RNAs (2002) Science 296: 1265-1269.*
"Establishment of the broad-spectrum resistance to tospoviruses in crops," http://btc.nchu,edu.tw/myweb3, pp. 1-12, 2008.
Bucher et al., "Multiple virus resistance at a high frequency using a single transgene construct," *J. of Gen. Virology*, 87:3697-3701, 2006.
Elbashir et al., "RNA interference is mediated by 21- and 22-nucleotide RNAs," *Genes & Devel*, 15:188-200, 2002.
Frizzi et al., "Modifying lysine biosynthesis and catabolism in corn with a single bifunctional expression/silencing transgene cassette," *Plant Biotech. J.*, 6:13-21, 2008.
Hamilton et al., "A species of small antisense RNA in post-transcriptional gene silencing in plants," *Science*, 286:950-952, 1999.
Lin et al., "A novel strategy for plant virus resistance using artificial miRNA," International Symposium, Ecological and Environmental Biosafety of Transgenic Plants, pp. 209-220, 2006.
Lopez-Ochoa et al., "Peptide aptamers that bind to a geminivirus replication protein interfere with viral replication in plant cells," *J. Virol*, 80:5841-5843, 2006.
Niu et al., "Expression of artificial microRNAs in transgenic *Arabidopsis thaliana* confers virus resistance," *Nature Biotech.*, 24(11):1420-1428, 2006.
Padidam et al., "A phage single-stranded DNA (ssDNA) binding protein complements ssDNA accumulation of a geminivirus and interferes with viral movement," *J. Gen Virol*, 73:1609-1616, 1999.
Praveen et al., "Small RNA mediated silencing to target tomato leaf curl virus," *J. of Plant Interactions*, 2(4):213-218, 2007.
Ramesh et al., "Hairpin RNA-mediated strategies for silencing of tomato leaf curl virus AC1 and AC4 genes for effective resistance in plants," *Oligonucleotides*, 17:251-257, 2007.
Safarnejad et al., "Recombinant-antibody-mediated resistance against tomato yellow leaf curl virus in *Nicotiana benthamiana*," *Arch. Virol.*, 154:457-467, 2009.

(Continued)

*Primary Examiner* — David T Fox
*Assistant Examiner* — Steven Bernacki
(74) *Attorney, Agent, or Firm* — Dentons US LLP; Thomas P. McBride, Esq.

(57) ABSTRACT

The present invention provides gene targets, constructs and methods for the genetic control of plant disease caused by multiple plant viruses. The present invention relates to achieving a plant protective effect through the identification of target coding sequences and the use of recombinant DNA technologies for post-transcriptionally repressing or inhibiting expression of the target coding sequences of plant-parasitic viruses. Protein-expression based approaches may also be utilized to augment phenotype resistance. Thus, transcription of a single transgenic event comprising one or more plant expression cassettes can allow for broad spectrum resistance of a plant to multiple plant viral strains and species among the *geminiviruses, tospoviruses,* and *potexviruses*.

18 Claims, 20 Drawing Sheets

OTHER PUBLICATIONS

Shepherd et al., "Transgenic strategies for developing crops resistant to geminiviruses," *Plant Sci.*, 176:1-11, 2009.

Sudarshana et al., "Methods for engineering resistance to plant viruses," *Methods in Molecular Biology*, 354:183-195, 2007.

Tenllado et al., "RNA interference as a new biotechnological tool for the control of virus diseases in plants," *Virus Res.*, 102(1):85-96, 2004.

Zrachya et al., "Production of siRNA targeted against TYLCV coat protein transcripts leads to silencing of its expression and resistance to the virus," *Transgenic Res.*, 16:385-398, 2007.

Resende et al., "Defective interfering L RNA segments of tomato spotted wilt virus retain both virus genome termini and have extensive internal deletions," *Journal of General Virology* 73:2509-2516, 1992.

* cited by examiner

FIG. 1
*Geminiviridae, Begomovirus, ssDNA*
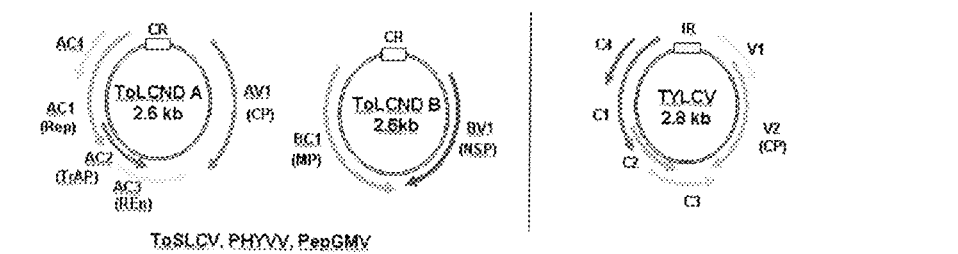
ToSLCV, PHYVV, PepGMV
*Bunyaviridae, Tospovirus, ssRNA*
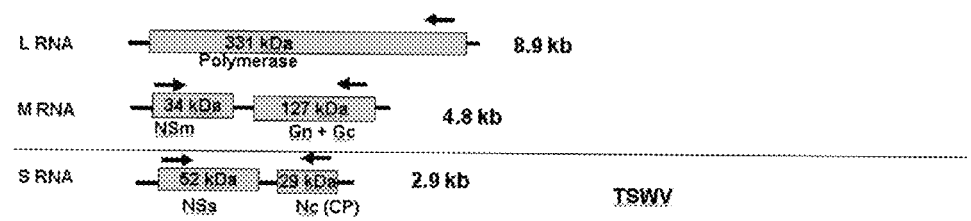
TSWV
*Flexiviridae, Potexvirus, ssRNA*
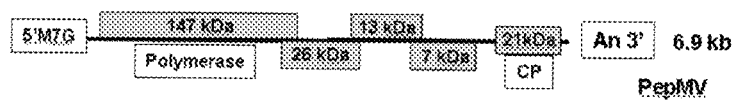
PepMV

FIG. 5

Gemini1: 5'TGTCATCAATGACGTTGTACT3' ΔΔG: 2.4 (targeting Rep)
```
TYLCV(AF024715)   5'GCGTGGTACAACGTCATTGATGACGTAGACC3'
ToLCNDV(U15015)   5'GCCTGGTACAACGTCATTGATGACGTTGATC3'
ToSLCV(AF130415)  5'GCGGAATACAACGTCATTGATGACATCACTC3'
PepGMV(U57457)    5'GTGGAGTATAACGTCATTGATGATATCACGC3'
PHYVV(X70418)     5'GCATGGTATAACGTCATTGATGACATCCCTC3'
Gemini1 miRNA        3'-TCATGTTGCAGTAACTACTGT-5'
```

Gemini2: 5'TGGACTTTACATGGGCCTTCA3' ΔΔG: 0.9 (targeting CP)
```
TYLCV(AF024715)   5'GGATGTGAAGGCCCATGTAAAGTCCAGTCTT3'
ToLCNDV(U15015)   5'GGCTCTGAAGGCCCTTGTAAAGTGCAGTCCT3'
ToSLCV(AF130415)  5'GGCTGTGAAGGCCCATGTAAGGTCCAGTCCT3'
PepGMV(U57457)    5'GGATGTGAAGGGCCATGTAAGGTCCAGTCCT3'
PHYVV(X70418)     5'GGTTGTGAAGGTCCCTGTAAGGTTCAATCGT3'
Gemini2 miRNA        3'-TCTTCCGGGTACATTTCAGGT-5'
```

Gemini3: 5'TACATGCCATATACAATAGCA3' ΔΔG: 1.2 (targeting CP)
```
TYLCV(AF024715)   5'CCTTGTTATTGTATATGGCATGTACGCATGC3'
ToLCNDV(U15015)   5'CATTAATGTTGTATATGGCCTGTACTCACGC3'
ToSLCV(AF130415)  5'CCCTGTTATTGTATATGGCATGTACTCATGC3'
PepGMV(U57457)    5'CCCTGCTATTGTATATGGCATGTACACATGC3'
PHYVV(X70418)     5'CGCTGTTATTGTATATGGCATGTACTCATGC3'
Gemini3 miRNA        3'-TCGATAACATATACCGTACAT-5'
```

Gemini4: 5'TCATAGAAGTAGATCCGGATT3' ΔΔG: -4.2 (targeting CP)
```
TYLCV(AF024715)   5'AAAATACGCATCTATTTCTATGATTCAATAT3'
TLCNDV(U15015)    5'AAAATCCGCATCTACTTTTATGATTCGGCCA3'
ToSLCV(AF130415)  5'AAGATCCGGATCTATTTTTATGATTCGGTAT3'
PepGMV(U57457)    5'AAAATTCGAATCTATTTTTATGATTCGATAA3'
PHYVV(X70418)     5'AAAATTCGGGTCTATTTTTATGACTCGATAA3'
Gemini4 miRNA        3'-TTAGGCCTAGATGAAGATACT-5'
```

Gemini5: 5'TTCCCCTGTGCGTGAATCCGT3' ΔΔG: 0.7 (targeting C2/C3)
```
TYLCV(AF024715)   5'AATCATGGATTCACGCACAGGGGAACTCATC3'
ToLCNDV(U15015)   5'GATCACGGATTCACGCACAGGGGAATACATC3'
ToSLCV(AF130415)  5'AACCATGGATTCACGCACAGGGGAGAGCATC3'
PepGMV(U57457)    5'AATAATGGATTCACGCACAGGGGAGAGCATC3'
PHYVV(X70418)     5'AACAATGGATTTACGCACCGGGGTACCCATC3'
Gemini5 miRNA        3'TGCCTAAGTGCGTGTCCCCTT-5'
```

Gemini6: 5'TTCCGCCTTTAATTTGGATTG3' ΔΔG: 1.6 (targeting Rep)
```
TYLCV(AF024715)   5'GCCCATTCAAATTAAAGGGGAATTCCCACT3'
ToLCNDV(U15015)   5'GCCGGTCATGATTAAAGGTGGAATTCCCACT3'
ToSLCV(AF130415)  5'GCCAGTTCAAATTAAAGGGGGAATACCGTCA3'
PepGMV(U57457)    5'GCCAGTTCAAATTAAAGGCGGGATACCATCA3'
PHYVV(X70418)     5'ACCAATTCAAATTAAAGGTGGGATACCCACT3'
Gemini6 miRNA       3'-GTTAGGTTTAATTTCCGCCTT-5'
```

Gemini7: 5'TTACATGGGCCTTCACAGCCT3' ΔΔG: -3.8 (targeting CP)
```
TYLCV(AF024715)   5'CCCCGTGGATGTGAAGGCCCATGTAAAGTCC3'
ToLCNDV(U15015)   5'CCAAGGGGCTGTGAAGGCCCTTGTAAAGTGC3'
ToSLCV(AF130415)  5'CCAAGGGGCTGTGAAGGCCCATGTAAGGTCC3'
PepGMV(U57457)    5'CCTAGAGGATGTGAAGGCCCATGTAAGGTCC3'
PHYVV(U57457)     5'CCGAAAGGTTGTGAAGGTCCCTGTAAGGTTC3'
Gemini7 miRNA        3'-TCCGACACTTCCGGGTACATT-5'
```

FIG. 6

L segment:

TospoL1-1: 5'TTTAGGCATCATATAGATAGC3' ΔΔG: -1.7 (targeting RdRP)

```
TSWV(D10066)        5'TTGGCTATTTATATGATGCCTAAATCACTGC3'
GBNV(AF025538)      5'CTAGCAATCTATATGATGCCTAAATCTTTGC3'
CapCV(DQ256124)     5'CTAGCAATCTATATGATGCCTAAATCACTCC3'
TospoL1-1 miRNA       3'-CGATAGATATACTACGGATTT-5'
```

TospoL1-2: 5'TGATTTAGGCATCATATAGAT3' ΔΔG: -0.2 (targeting RdRP)

```
TSWV(D10066)        5'TTGGCTATTTATATGATGCCTAAATCACTGC3'
GBNV(AF025538)      5'CTAGCAATCTATATGATGCCTAAATCTTTGC3'
CapCV(DQ256124)     5'CTAGCAATCTATATGATGCCTAAATCACTCC3'
TospoL1-2 miRNA           3'-TAGATATACTACGGATTTAGT-5'
```

M segment:

TospoM1: 5'TATCTATATTTTCCATCTACC3' ΔΔG: 0.2 (targeting GP)

```
TSWV(S48091)        5'TGTTGTAGACCGCAAATATAGATATATGATA3'
GBNV(U42555)        5'TGAAGTAGATGGGAAATATAGATATCTTTTA3'
CapCV(DQ256125)     5'AGAGGTTGATGGAAAATACAGATATCTTATA3'
TospoM1 miRNA         3'-CCATCTACCTTTTATATCTAT-5'
```

TospoM2: 5'TTAGTTTGCAGGCTTCAATTA3' ΔΔG: 0.2 (targeting NSm)

```
TSWV(S48091)        5'CATTCATTGAAGCCTGCAAGCTGATAATTCC3'
GBNV(U42555)        5'CTCTAATTGAAGCATGCAAATTAATGATACC3'
CapCV(DQ256125)     5'CTTTGATTGAAGCATGCAAATTAATGATACC3'
TospoM2 miRNA         3'-TTTAACTTCGGACGTTTGATT-5'
```

TospoM3: 5'TTGCATGCTTCAATGAGAGCA3' ΔΔG: -0.4 (targeting NSm)

```
TSWV(S48091)        5'TCTCAGGCATTCATTGAAGCCTGCAAGCTGA3'
GBNV(U42555)        5'GCTGCTGCTCTAATTGAAGCATGCAAATTAA3'
CapCV(DQ256125)     5'GCTGCTGCTTTGATTGAAGCATGCAAATTAA3'
TospoM3 miRNA             3'-TCGAGAGTAACTTCGTACGTT-5'
```

S segment:

TospoS2: 5'TCGTCGTTAGACATGGTGTTT3' ΔΔG: -1.6 (targeting N)

```
TSWV(D00645)        5'ACGATCATCATGTCTAAGGTTAAGCTCACTA3'
GBNV(U27809)        5'GTAAACACCATGTCTAACGTCAAGCAACTCA3'
CapCV(DQ355974)     5'GTAAACACCATGTCTAACGTCAGGCAACTTA3'
TospoS2 miRNA        3'-TTTGTGGTACAGATTGCTGCT-5'
```

TospoS3: 5'TAGAAAGTTTTGAACTTGAAT3' ΔΔG: -1.0 (targeting N)

```
TSWV(D00645)        5'GGTAGCATTCAACTTCAAGACTTTTTGTCTG3'
GBNV(U27809)        5'TCCCGGATTTAGCTTTAAAGCTTTCTATGAC3'
CapCV(DQ355974)     5'TCCAGGATTCAACTTCAAGACATTTTATGAT3'
TospoS3 miRNA              3'-TAAGTTGAAGTTTTGAAAGAT-5'
```

FIG. 7A

PepMV1: 5'TCTTCATTGTAGTTAATGGAG3' ΔΔG: -0.4 (targeting RdRP)

```
AY509926      5'ATATACTCCATTAACTACAATGAAGAAGGCT3'
AJ438767      5'ATTTACTCCATTAACTACAATGAAGAAGGCT3'
DQ000984      5'ATATACTCCATTAACTACAATGAAGAAGGCT3'
DQ000985      5'ATATACTCCATTAACTACAATGAAGAAGGTT3'
AY509927      5'ATATACTCCATTAATTACAATGAAGAAGGTT3'
EF480021      5'ATATACTCCATTAATTACAATGAAGAAGGTT3'
AM491606      5'ATTTACTCCATTAACTACAATGAAGAAGGCT3'
AJ606360      5'ATTTACTCCATTAACTACAATGAAGAAGGCT3'
AJ606359      5'ATTTACTCCATTAACTACAATGAAGAAGGCT3'
AJ606361      5'ATTTACTCCATTAACTACAATGAAGAAGGCT3'
AF484251      5'ATTTACTCCATTAACTACAATGAAGAAGGCT3'
AM109896      5'ATTTACTCCATTAACTACAATGAAGAAGGCT3'
EF599605      5'ATATACTCCATTAATTACAATGAAGAAGGTT3'

PepMV1 miRNA  3'GAGGTAATTGATGTTACTTCT5'
```

PepMV2: 5'TTGGAAGAGGAAAAGGTGGTT3' ΔΔG: -2.5 (targeting RdRP)

```
AY509926      5'GCGCCAACCACCTTTTCCTTTTCCAAAGAGG3'
AJ438767      5'GTGCCAACCACCTTTTCCTCTTCCAAAGAGG3'
DQ000984      5'GCGCCAACCACCTTTTCCTTTTCCAAAGAGG3'
DQ000985      5'GAGCCAACCACCTTTTCCTCTTCCAAAGAGG3'
AY509927      5'GAGCCAACCATCTTTTCCTCTTCCAAAGAGG3'
EF480021      5'GAGCCAACCATCTTTTCCTCTTCCAAAGAGG3'
AM491606      5'GTGCCAACCACCTTTTCCTCTTCCAAAGAGG3'
AJ606360      5'GTGCCAACCACCTTTTCCTCTTCCAAAGAGG3'
AJ606359      5'GTGCCAACCACCTTTTCCTCTTCCAAAGAGG3'
AJ606361      5'GTGCCAACCACCTTTTCCTTTTCCAAAGAGG3'
AF484251      5'GTGCCAACCACCTTTTCCTCTTCCAAAGAGG3'
AM109896      5'GTGCCAACCACCTTTTCCTTTTCCAAAGAGG3'
EF599605      5'GAGCCAACCATCTTTTCCTCTTCCAAAGAGG3'

PepMV2 miRNA  3'TTGGTGGAAAAGGAGAAGGTT5'
```

PepMV3: 5'TCAATCATGCACCTCCAGTCG3' ΔΔG: -2.5 (targeting RdRP)

```
AY509926      5'CAACAAGACTGGAGGTGCATGATTGAAYTCT3'
AJ438767      5'CAACACGACTGGAGGTGCATGATTGAATTCT3'
DQ000984      5'CAACACGACTGGAGGTGCATGATTGAATTCT3'
DQ000985      5'CAACATGACTGGAGGTGCATGATTGAATTCT3'
AY509927      5'CAACATGACTGGAGGTGCATGATTGAATTCT3'
EF480021      5'CAACATGACTGGAGGTGCATGATTGAATTCT3'
AM491606      5'CAACACGACTGGAGGTGCATGATTGAATTCT3'
AJ606360      5'CAACACGACTGGAGGTGCATGATTGAATTCT3'
AJ606359      5'CAACACGACTGGAGGTGCATGATTGGATTCT3'
AJ606361      5'CAACACGACTGGAGGTGCATGATTGAATTCT3'
AF484251      5'CAACACGACTGGAGGTGCATGATTGAATTCT3'
AM109896      5'CAACACGACTGGAGGTGCATGATTGAATTCT3'
EF599605      5'CAACATGACTGGAGGTGCATGATTGAATTCT3'

PepMV3 miRNA  3'GCTGACCTCCACGTACTAACT5'
```

FIG. 7B

PepMV4: 5'TAAGTAGCAAGGCCTAGGTGA3'  ΔΔG: -2.2 (targeting TGBp1)

```
AY509926    5'TAGGATCACCTAGGCCTTGTTATTTAGATAA3'
AJ438767    5'TAGGTTCACCTAGGCCTTGCTATTTAGATAA3'
DQ000984    5'TAGGATCACCTAGGCCTTGTTACTTAGATAA3'
DQ000985    5'TAGGTTCACCTAGGCCTTGTTACTTAGATAA3'
AY509927    5'TAGGATCACCTAGGCCTTGTTATTTAGATAA3'
EF480021    5'TAGGTTCACCTAGGCCTTGTTACTTAGATAA3'
AM491606    5'TAGGTTCACCTAGGCCTTGCTATTTAGATAA3'
AJ606360    5'TAGGTTCACCTAGGCCTTGCTATTTAGATAA3'
AJ606359    5'TAGGTTCACCTAGGCCTTGCTATTTAGATAA3'
AJ606361    5'TAGGTTCACCTAGGCCTTGTTATTTAGACAA3'
AF484251    5'TAGGTTCACCTAGGCCTTGCTATTTAGATAA3'
AM109896    5'TAGGTTCACCTAGGCCTTGTTATTTAGACAA3'
EF599605    5'TAGGTTCACCTAGGCCTTGTTACTTAGATAA3'

PepMV4 miRNA    3'AGTGGATCCGGAACGATGAAT5'
```

PepMV5: 5'TTTGGAAGTAAATGCAGGCTG3'  ΔΔG: -4.5 (targeting TGBp2)

```
AY509926    5'GTTGTCAGCTTGCATTTACTTCCAAAACAGC3'
AJ438767    5'GTTGTCAGCTTGCATTTACTTCCAAAATAGC3'
DQ000984    5'GTTGTCAGCTTGCATTTACTTCCAAAACAGC3'
DQ000985    5'ACTGTCAGCTTGCATTTACTTCCAAAACAGT3'
AY509927    5'ACTGTCAGCTTGCATTTACTTCCAAAACAGT3'
EF480021    5'ACTGTCAGCTTGCATTTACTTCCAAAACAGT3'
AM491606    5'GTTGTCAGCTTGCATTTACTTCCAAAATAGC3'
AJ606360    5'GTTGTCAGCTTGCATTTACTTCCAAAATAGC3'
AJ606359    5'GTTGTCAGCTTGCATTTACTTCCAAAATAGC3'
AJ606361    5'GTTGTCAGCCTGCATTTACTTCCAAAATAGC3'
AF484251    5'GTTGTCAGCTTGCATTTACTTCCAAAATAGC3'
AM109896    5'GTTGTCAGCCTGCATTTACTTCCAAAATAGC3'
EF599605    5'ACTGTCAGCTTGCATTTACTTCCAAAACAGT3'

PepMV5 miRNA    3'GTCGGACGTAAATGAAGGTTT5'
```

PepMV6: 5'TAACCCGTTCCAAGGGGAGAAG3'  ΔΔG: -3.9 (targeting TGBp3)

```
AY509926    5'TCAACTTCTCCCCTTGGAACGGGTTAAGTTT3'
AJ438767    5'TCAACTTCTCCCCTTGGAACGGGTTAAGTTT3'
DQ000984    5'TCAACTTCTCCCCTTGGAACGGGTTAAGTTT3'
DQ000985    5'TCAACTTCTCCCCTTGGAACGGGTTAAGTTT3'
AY509927    5'TCAACTTCTCCCCTTGGAACGGGTTAAGTTT3'
EF480021    5'TCAACTTCTCCCCTTGGAACGGGTTAAGTTT3'
AM491606    5'TCAACTTCTCCCCTTGGAACGGGTTAAGTTT3'
AJ606360    5'TCAACTTCTCCCCTTGGAACGGGTTAAGTTT3'
AJ606359    5'TCAACTTCTCCCCTTGGAACGGGTTAAGTTT3'
AJ606361    5'TCAACTTCTCCCCTGGAACGGGTTAAGTTT3'
AF484251    5'TAAACTTCTCCCCTTGGAACGGGTTAAGTTT3'
AM109896    5'TCAACTTCTCCCCCTGGAACGGGTTAAGTTT3'
EF599605    5'TCAACTTCTCCCCTTGGAACGGGTTAAGTTT3'

PepMV6 miRNA    3'AAGAGGGGGACCTTGCCCAAT5'
```

FIG. 9

Cassette 1: Promoter — intron — Coding region — Terminator
- dsRNA against all Gemini targets or dsRNA against all Tospo targets
- Anti-tospogenome sequence
- Tospo coat protein, G6 ssDNA binding protein, antiviral protein aptamer, other DNA/RNA binding proteins Cassette 2: Promoter — Internal ribosomal entry site (IRES) — Terminator
- Tospo coat protein, G6 ssDNA binding protein, antiviral protein aptamer, other DNA/RNA binding proteins
- dsRNA against all Gemini targets or dsRNA against all Tospo targets FIG. 10
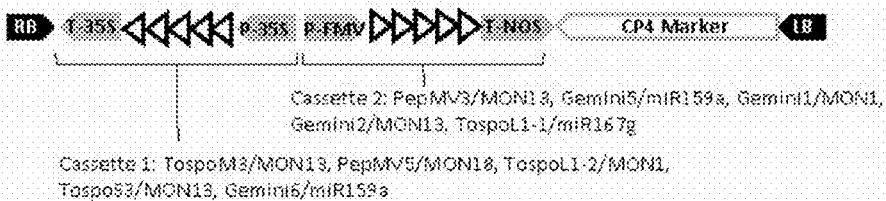
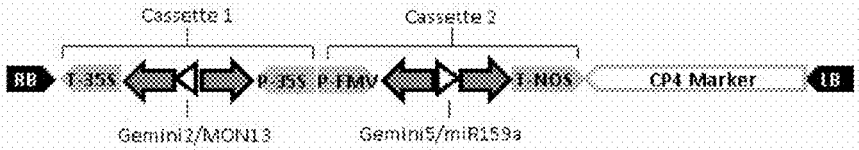

FIG. 11A

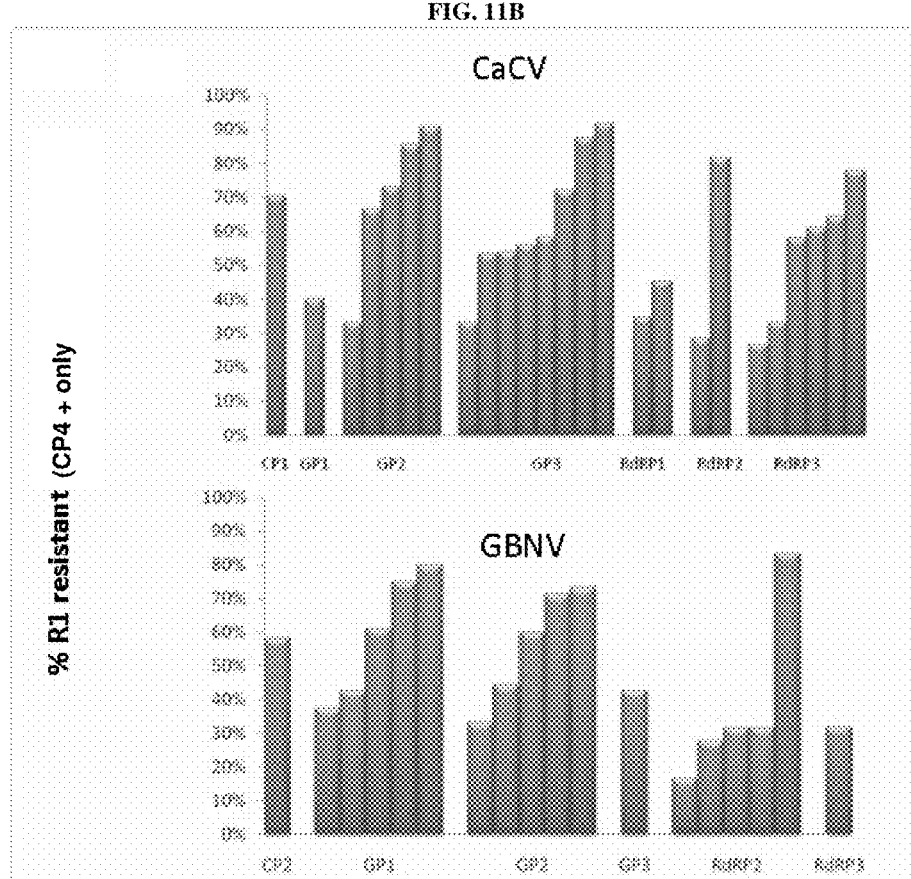

MULTIPLE VIRUS RESISTANCE IN PLANTS

This application claims the priority of U.S. Provisional Appl. Ser. No. 61/171,021, filed Apr. 20, 2009, the entire disclosure of which is incorporated herein by reference.

BACKGROUND OF THE INVENTION

1. Field of the Invention

The present invention relates generally to methods and compositions for enhancing resistance to multiple plant viruses.

2. Description of Related Art

Solanaceous plants are subject to multiple potential disease causing agents, including virus-induced diseases that are responsible for major crop losses worldwide. For many RNA viruses, expression of transgenic coat protein (CP) or replicase blocks the progression of the virus infectious process. RNA-based resistance makes use of the plant post-transcriptional gene silencing (PTGS) mechanism to degrade viral RNAs. However, such approaches may yield resistance that is narrowly based and/or not durable, especially with rapidly spreading/evolving new viral species or isolates. In some instances, classically-defined (non-transgenic) resistance traits are available to aid in development of virus resistant plants. Additionally, control of plant pests, such as insects that serve to transmit plant viruses, may help to limit losses due to viral infection of plants.

BRIEF DESCRIPTION OF THE FIGURES

FIG. 1: Schematic diagram of genome organization of viruses of interest.

FIG. 5: Suitable 21nt sequences (among SEQ ID NOs:1-42) that were analyzed against five targeted *Geminiviruses* (perfect match: double underline; G:U mis-match: single underline; other mis-match or not utilized: not underlined).

FIG. 6: Suitable 21nt sequences (among SEQ ID NOs:43-70) that were analyzed against *tospoviruses* (perfect match: double underline; G:U mis-match: single underline; other mis-match or not utilized: not underlined).

FIG. 7A, 7B: Suitable 21nt sequences (among SEQ ID NOs:71-154) that were analyzed against targeted *potexviruses* (perfect match: double underline; G:U mis-match: single underline; other mis-match or not utilized: not underlined).

FIG. 9: Schematic diagram illustrating expression cassette for deploying multiple modes of action for virus resistance.

FIGS. 10A, 10B, 10C: Additional exemplary constructs for deploying multiple engineered miRNAs in a transgenic cassette, as well as for expressing miRNA along with dsRNA.

FIG. 11A, 11B: Scanning of regions of the *tospovirus* genome to define segments which may be expressed as dsRNA with anti-viral efficacy. X axis represents individual events and target regions (CP: coat protein; GP: envelope glycoprotein; and RdRP: RNA-dependent RNA polymerase). Y axis represents % of transgenic $R_1$ plants displaying virus resistance. FIG. 11A: TSWV results; FIG. 11B: CaCV and GBNV results. "CP4+" refers to presence of the selectable marker gene linked to the dsRNA-encoding sequence, in $R_1$ plants.

FIG. 13A: representative results for TYLCV and ToSLCV; FIG. 13B: representative results for PepGMV, PHYVV, and ToLCNDV. For PHYVV and ToLCNDV events, "Spc" refers to the presence of a selectable marker gene conferring spectinomycin resistance. Other events were transformed with a construct comprising a selectable marker gene conferring glyphosate resistance ("CP4 positive").

FIG. 14: Schematic diagram illustrating representative expression cassettes for targeting of multiple viruses in multiple virus families.

FIG. 15: Results of using an artificial dsRNA fusion construct targeting CP expression of *tospoviruses* and PepMV (*potexvirus*), for multiple virus resistance as discussed in Example 3. Construct used is schematically shown in FIG. 4B, bottom construct: TSWV (160 bp), TSWV (296 bp), PepMV (231 bp), CaCV/GBNV (232 bp).

SUMMARY OF THE INVENTION

Figure 2A:
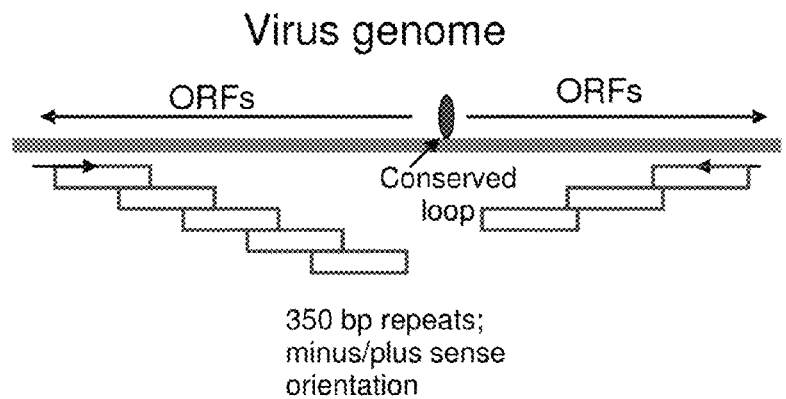
FIG. 2A: Schematic diagram illustrating approach for identifying sequence efficacious for plant virus control.

The present invention provides methods and compositions for obtaining plants resistant to multiple plant viruses. In one aspect, the present invention provides a tomato plant comprising resistance to a plurality of plant virus species. In certain embodiments, the resistance is provided by at least two different modes of action selected from the group consisting of dsRNA, miRNA, and inhibition of virion assembly. In other embodiments, the resistance is provided by at least three different modes of action. The resistance of the tomato plant may comprise resistance against a *begomovirus, tospovirus* or *potexvirus*.

In certain embodiments, the resistance provided to at least one of the plant virus species is provided by expression of a nucleic acid construct that produces dsRNA. In some embodiments the resistance provided to at least one of the plant virus species is provided by expression of a dsRNA fusion construct. In some embodiments of the invention, the dsRNA interferes with expression of a virus coat protein gene, a virus movement protein gene or a virus replication gene. In particular embodiments, the nucleic acid construct which produces dsRNA comprises a sequence selected from the group consisting of SEQ ID NOs:379-455.

In other embodiments, the resistance provided to at least one of the plant virus species is provided by expression of a nucleic acid construct that produces miRNA. Thus, in certain embodiments, the resistance against a *begomovirus* or *tospovirus* is provided by a sequence encoded by a stacked miRNA expression cassette. In yet other embodiments, the miRNA interferes with expression of a virus coat protein gene, a virus movement protein gene or a virus replication gene. In particular embodiments, the miRNA comprises a sequence selected from the group consisting of SEQ ID NOs: 1, 7, 13, 19, 25, 31, 37, 43, 47, 51, 55, 59, 63, 67, 71, 85, 99, 113, 127, and 141.

In certain embodiments, the tomato plant comprises (a) resistance against a *begomovirus* which is provided by expression of dsRNA which interferes with expression of a *begomovirus* replication gene; (b) resistance against a *tospovirus* or *potexvirus* which is provided by expression of a dsRNA which interferes with expression of a virus coat protein gene or virus movement protein gene; (c) resistance against a *potexvirus* which is provided by expression of a nucleic acid construct which produces miRNA; or (d) resistance against a *begomovirus* or *tospovirus* which is provided by a sequence encoded by a stacked miRNA expression cassette.

In other embodiments, a tomato plant is provided wherein resistance provided to at least one of the plant virus species is provided by expression of a *tospovirus* genome segment terminal sequence that inhibits virion assembly. In certain embodiments, resistance provided to at least one of the plant virus species is provided by inhibiting virion assembly, wherein virion assembly is inhibited by a sequence comprised within a nucleic acid construct comprising a first nucleic acid segment and a second nucleic acid segment, wherein the first and second segments are substantially inverted repeats of each other and are linked together by a third nucleic acid segment, and wherein the third segment comprises at least one terminal sequence of a *tospovirus* genome segment that inhibits virion assembly. In particular embodiments, the third nucleic acid comprises a *tospovirus* genome terminal sequence selected from the group consisting of: a terminal sequence of a CaCV or GBNV L genome segment, a terminal sequence of a CaCV or GBNV M genome segment, a terminal sequence of a CaCV or GBNV S genome segment, a *tospovirus* genome terminal repeat sequence, a nucleic acid sequence comprising SEQ ID NO: 167, a nucleic acid sequence comprising SEQ ID NO:168, a nucleic acid sequence comprising SEQ ID NO:376, a nucleic acid sequence comprising SEQ ID NO:377, a nucleic acid sequence comprising SEQ ID NO:378, and a nucleic acid sequence comprising SEQ ID NO: 455.

In certain embodiments, the tomato plant comprises resistance to viruses of at least two of the Geminiviridae, Bunyaviridae and Flexiviridae families. Thus, in some embodiments the viruses are selected from the genera *potexvirus, tospovirus,* and *begomovirus*. In particular embodiments, the viruses are selected from the group consisting of: a) at least one of TYLCV, ToSLCV, ToLCNDV, PHYVV, PepGMV; b) one or more of TSWV, GBNV, CaCV; and c) PepMV. In a more particular embodiment, the *potexvirus* is Pepino mosaic virus. In certain embodiments, the *begomovirus* is TYLCV, ToLCNDV, PHYVV, ToSLCV, or PepGMV. In some embodiments, the tospovirus is CaCV, GBNV, or TSWV. In particular embodiments, the *begomovirus* is TYLCV and the *potexvirus* is Pepino mosaic virus; or the tospovirus is TSWV and the *potexvirus* is Pepino mosaic virus; or the wherein the *begomovirus* is TYLCV, the *potexvirus* is Pepino mosaic virus, and the tospovirus is TSWV.

In some embodiments, the tomato plant may comprise a sequence selected from the group consisting of SEQ ID NOs: 156, 158, 160, 162, 164, 166, and 363-375. In those or other embodiments, the tomato plant comprises, or further comprises, a sequence selected from the group consisting of: SEQ ID NOs:1, 7, 13, 19, 25, 31, 37, 43, 47, 51, 55, 59, 63, 67, 71, 85, 99, 113, 127, 141, and 379-454. Thus, a tomato plant of the invention may comprise: (a) at least one sequence selected from the group consisting of SEQ ID NOs:379-454 and at least one sequence selected from the group consisting of SEQ ID NOs:167, 168, 376, 377, 378, and 455; (b) at least one sequence selected from the group consisting of SEQ ID NOs: 379-454 and at least one sequence selected from the group consisting of SEQ ID NOs:1, 7, 13, 19, 25, 31, 37, 43, 47, 51, 55, 59, 63, 67, 71, 85, 99, 113, 127, and 141; or (c) at least one sequence selected from the group consisting of SEQ ID NOs: 1, 7, 13, 19, 25, 31, 37, 43, 47, 51, 55, 59, 63, 67, 71, 85, 99, 113, 127, and 141 and at least one sequence selected from the group consisting of SEQ ID NOs:167, 168, 376, 377, 378, and 455.

In yet other embodiments, the tomato plant comprises at least one heterologous nucleic acid sequence that confers viral resistance selected from the group consisting of a) a nucleic acid sequence that encodes an RNA sequence that is complementary to all or a part of a first target gene; b) a nucleic acid sequence that comprises multiple copies of at least one anti-sense DNA segment that is anti-sense to at least one segment of said at least one first target gene; c) a nucleic acid sequence that comprises a sense DNA segment from at least one target gene; d) a nucleic acid sequence that comprises multiple copies of at least one sense DNA segment of a target gene; e) a nucleic acid sequence that transcribes to RNA for suppressing a target gene by forming double-stranded RNA and that comprises at least one segment that is anti-sense to all or a portion of the target gene and at least one sense DNA segment that comprises a segment of said target gene; f) a nucleic acid sequence that transcribes to RNA for suppressing a target gene by forming a single double-stranded RNA that comprises multiple serial anti-sense DNA segments that are anti-sense to at least one segment of the target gene and multiple serial sense DNA segments that comprise at least one segment of said target gene; g) a nucleic acid sequence that transcribes to RNA for suppressing a target gene by forming multiple double strands of RNA and comprises multiple segments that are anti-sense to at least one segment of said target gene and multiple sense DNA segments of the target gene, and wherein said multiple anti-sense DNA segments and said multiple sense DNA segments are arranged in a series of inverted repeats; h) a nucleic acid sequence that comprises nucleotides derived from a plant miRNA; and i) a nucleic acid sequence encoding at least one tospovirus terminal sequence that interferes with virion assembly. The invention also provides a plant wherein expression of the at least one heterologous nucleic acid sequence results in resistance to two or more viruses selected from the group consisting of: *tospoviruses, begomoviruses,* and *potexviruses*. The plant may also further comprise a non-transgenic plant virus resistance trait.

In another aspect of the invention, a transgenic seed is provided, of any generation of the tomato plant comprising resistance to a plurality of plant virus species, wherein the resistance is provided by at least two different modes of action selected from the group consisting of dsRNA, miRNA, and inhibition of virion assembly.

In yet another aspect, the invention provides a method for conferring resistance in a tomato plant to a plurality of plant virus species, the method comprising expressing in the plant at least two nucleic acid sequences that collectively provide resistance to said plurality of plant virus species, wherein at least 2 different modes of action are utilized to provide such resistance, comprising expression of at least two sequences selected from the group consisting of: dsRNA, miRNA, and a sequence which interferes with virion assembly. In certain embodiments, the resistance comprises resistance against a *begomovirus, tospovirus* or *potexvirus*.

The resistance may be provided to at least one of the plant virus species by expression of a nucleic acid construct that produces dsRNA. In particular embodiments, resistance provided to at least one of the plant virus species is provided by expression of a dsRNA fusion construct. In more particular embodiments, the dsRNA interferes with expression of a virus coat protein gene, a virus movement protein gene or a virus replication gene. In yet more particular embodiments, the nucleic acid construct comprises a sequence selected from the group consisting of SEQ ID NOs:379-455.

In other embodiments, resistance provided to at least one of the plant virus species is provided by expression of a nucleic acid construct that produces miRNA. In one embodiment, it is contemplated that resistance against a *begomovirus* or tospovirus is provided by a sequence encoded by a stacked miRNA expression cassette. The produced miRNA may further interfere with expression of a virus coat protein gene, a virus movement protein gene or a virus replication gene. In particular embodiments, the miRNA comprises a sequence selected from the group consisting of SEQ ID NOs:1, 7, 13, 19, 25, 31, 37, 43, 47, 51, 55, 59, 63, 67, 71, 85, 99, 113, 127, and 141.

Thus, in certain embodiments, (a) resistance against a *begomovirus* is provided by expression of dsRNA which interferes with expression of a *begomovirus* replication gene; (b) resistance against a tospovirus or *potexvirus* is provided by expression of a dsRNA which interferes with expression of a virus coat protein gene or virus movement protein gene; (c) resistance against a *potexvirus* is provided by expression of a nucleic acid construct which produces miRNA; or (d) resistance against a *begomovirus* or tospovirus is provided by a sequence encoded by a stacked miRNA expression cassette.

In some embodiments resistance provided to at least one of the plant virus species is provided by expression of a tospovirus genome segment terminal sequence that inhibits virion assembly. In certain embodiments, resistance is provided to at least one of said plant virus species by inhibiting virion assembly, wherein virion assembly is inhibited by a sequence comprised within a nucleic acid construct comprising a first nucleic acid segment and a second nucleic acid segment, wherein the first and second segments are substantially inverted repeats of each other and are linked together by a third nucleic acid segment, and wherein the third segment comprises at least one terminal sequence of a tospovirus genome segment, expression of which inhibits virion assembly. Further, in particular embodiments, the third nucleic acid may comprise a tospovirus genome terminal sequence selected from the group consisting of: a terminal sequence of a CaCV or GBNV L genome segment, a terminal sequence of a CaCV or GBNV M genome segment, a terminal sequence of a CaCV or GBNV S genome segment, and a tospovirus genome terminal repeat sequence. In more particular embodiments, the terminal sequence or terminal repeat sequence comprises SEQ ID NO:167, SEQ ID NO:168, SEQ ID NO:376, SEQ ID NO:377, or SEQ ID NO: 378.

In other embodiments of the invention, the plurality of plant virus species are selected from at least two of the Geminiviridae, Bunyaviridae and Flexiviridae families. Thus, the viruses may be selected from the genera *Potexvirus, Tospovirus*, and *Begomovirus*. In certain embodiments, the viruses are selected from the group consisting of: a) one or more of TYLCV, ToSLCV, ToLCNDV, PHYVV, PepGMV; b) one or more of TSWV, GBNV, CaCV; and c) PepMV.

In other embodiments, the nucleic acid sequence comprises at least one gene suppression element for suppressing at least one first target gene. For instance, the method may comprise expressing in the plant: a) at least one sequence selected from the group consisting of SEQ ID NOs:379-454 and at least one sequence selected from the group consisting of SEQ ID NOs:167, 168, 376, 377, 378, and 455; (b) at least one sequence selected from the group consisting of SEQ ID NOs:379-454 and at least one sequence selected from the group consisting of SEQ ID NOs:1, 7, 13, 19, 25, 31, 37, 43, 47, 51, 55, 59, 63, 67, 71, 85, 99, 113, 127, and 141; or (c) at least one sequence selected from the group consisting of SEQ ID NOs:1, 7, 13, 19, 25, 31, 37, 43, 47, 51, 55, 59, 63, 67, 71, 85, 99, 113, 127, and 141 and at least one sequence selected from the group consisting of SEQ ID NOs:167, 168, 376, 377, 378, and 455.

Another aspect of the invention provides a transgenic cell of the tomato plant comprising resistance to a plurality of plant virus species, wherein the resistance is provided by at least two different modes of action selected from the group consisting of dsRNA, miRNA, and inhibition of virion assembly.

The term "about" is used to indicate that a value includes the standard deviation of error for the device or method being employed to determine the value. The use of the term "or" in the claims is used to mean "and/or" unless explicitly indicated to refer to alternatives only or the alternatives are mutually exclusive, although the disclosure supports a definition that refers to only alternatives and to "and/or." When not used in conjunction closed wording in the claims or specifically noted otherwise, the words "a" and "an" denote "one or more." The term "conferred by a transgene," for example, thus encompasses one ore more transgene(s).

The terms "comprise," "have" and "include" are open-ended linking verbs. Any forms or tenses of one or more of these verbs, such as "comprises," "comprising," "has," "having," "includes" and "including," are also open-ended. For example, any method that "comprises," "has" or "includes" one or more steps is not limited to possessing only those one or more steps and also covers other unlisted steps. Similarly, any plant that "comprises," "has" or "includes" one or more traits is not limited to possessing only those one or more traits and covers other unlisted traits.

Other objects, features and advantages of the present invention will become apparent from the following detailed description. It should be understood, however, that the detailed description and any specific examples provided, while indicating specific embodiments of the invention, are given by way of illustration only, since various changes and modifications within the spirit and scope of the invention will become apparent to those skilled in the art from this detailed description.

DETAILED DESCRIPTION OF THE INVENTION

The following is a detailed description of the invention provided to aid those skilled in the art in practicing the present invention. Those of ordinary skill in the art may make modifications and variations in the embodiments described herein without departing from the spirit or scope of the present invention.

The present invention provides methods and compositions for genetic control of virus diseases in plants, including Solanaceous plants such as tomato (i.e. *Lycopersicon* or *Solanum* sp.), pepper (i.e. *Capsicum* sp.), petunia (i.e. *Petunia* sp.), and potato and eggplant (i.e. *Solanum* sp). In one embodiment RNA-mediated gene suppression can be conferred by the expression of an inverted-repeat transgene cassette that generates a population of small interfering RNAs (siRNAs) derived from the dsRNA region of a transgene transcript. Another RNA-mediated approach for gene suppression is by expression of one or more miRNA segments that "target" specific transcripts and lead to their degradation. Thus approaches including engineering dsRNA, miRNA, ta-siRNA and/or phased siRNA may be utilized in accordance with the invention. For instance, *begomovirus*-derived, or other virus-derived sequences targeting replication, coat protein, and C2 and/or C3 proteins may also be utilized. Likewise, for control of *potexviruses* such as Pepino mosaic virus, sequences targeting portions of coat (capsid) protein ("CP"), replication protein such as RNA-dependent RNA polymerase ("RdRP"), and/or one or more movement protein(s) ("MP") which may include a triple gene block ("TGB") or a "30K" MP may be used. For control of *tospoviruses*, sequences targeting, for instance, the coat protein ("CP", also termed the nucleocapsid, "N" protein), RdRP, movement protein ("NsM"), and/or non-structural glyocoprotein(s) (encoded by "G1" or G2" genes) may similarly be utilized. Such sequences may correspond exactly to sequences from one or more viral isolates, or may be variants, for instance designed to increase their antiviral efficacy, or avoid non-target effects.

In certain embodiments, multiple virus resistance ("MVR") is achieved by utilizing dsRNA and/or miRNA expressed from a single transformed construct, or more than one construct. Further, a single construct may comprise one or more expression cassettes that produce dsRNA and/or miRNA that targets one or more functions necessary for plant viral infection, multiplication, and/or transmission, as well as, in certain embodiments, one or more expression cassettes that produce at least one mRNA that encodes a protein, or portion of a protein, being targeted. Thus, resistance to multiple plant viruses may be achieved in a single transgenic "event." RNA mediated resistance may further be enhanced by protein based approaches utilizing aptamer(s) that inhibit replication, expression or mutation in replicase or replication associated proteins, ssDNA binding proteins such as m13-G5 (e.g. U.S. Pat. No. 6,852,907; Padidam et al., 1999), for *geminivirus* resistance, or a peptide aptamer that interferes with *geminivirus* replication may also be employed (e.g. Lopez-Ochoa et al., 2006).

It is also contemplated that inhibition of virion assembly, for instance by a nucleic-acid based approach, may be utilized as a mode of action in providing virus resistance to a tomato plant. This inhibition of virion assembly may be provided, for instance, by use of a tospovirus terminal sequence, such as a terminal repeat sequence. By "inhibition of virion assembly" is meant interference with the interaction between viral capsid proteins and nucleic acid(s) which together may form a viral particle ("virion"). Such interference may occur, for instance, by expression of a sequence that can serve as an artificial substrate competing for reverse transcriptase, and/or may occur by interference with proper circularization of replicating viral genome components.

Additionally, classical genetic resistance loci for tolerance in tomato, peppers, and other Solanaceous plants may be utilized, for instance through classical breeding approaches. In certain embodiments, protein-based approaches using tospovirus "N" gene (nucleocapsid; coat protein) plus/minus inverted repeats and a *potexvirus* (e.g. Pepino mosaic virus) coat protein (CP) and replicase for resistance, are also provided.

Methods of gene suppression may include use of anti-sense, co-suppression, and RNA interference. Anti-sense gene suppression in plants is described by Shewmaker et al. in U.S. Pat. Nos. 5,107,065, 5,453,566, and 5,759,829. Gene suppression in bacteria using DNA which is complementary to mRNA encoding the gene to be suppressed is disclosed by Inouye et al. in U.S. Pat. Nos. 5,190,931, 5,208,149, and 5,272,065. RNA interference or RNA-mediated gene suppression has been described by, e.g., Redenbaugh et al., 1992; Chuang et al., 2000; and Wesley et al., 2001.

Several cellular pathways involved in RNA-mediated gene suppression have been described, each distinguished by a characteristic pathway and specific components. See, for example, reviews by Brodersen and Voinnet (2006), and Tomari and Zamore (2005). The siRNA pathway involves the non-phased cleavage of a double-stranded RNA to small interfering RNAs ("siRNAs"). The microRNA pathway involves microRNAs ("miRNAs"), non-protein coding RNAs generally of between about 19 to about 25 nucleotides (commonly about 20-24 nucleotides in plants) that guide cleavage in trans of target transcripts, negatively regulating the expression of genes involved in various regulation and development pathways; see Ambros et al. (2003). Plant miRNAs have been defined by a set of characteristics including a paired stem-loop precursor that is processed by DCL1 to a single specific ~21-nucleotide miRNA, expression of a single pair of miRNA and miRNA* species from the double-stranded RNA precursor with two-nucleotide 3' overhangs, and silencing of specific targets in trans (see Bartel (2004); Kim (2005); Jones-Rhoades et al. (2006); Ambros et al. (2003)). In the trans-acting siRNA ("ta-siRNA") pathway, miRNAs serve to guide in-phase processing of siRNA primary transcripts in a process that requires an RNA-dependent RNA polymerase for production of a double-stranded RNA precursor; trans-acting siRNAs are defined by lack of secondary structure, a miRNA target site that initiates production of double-stranded RNA, requirements of DCL4 and an RNA-dependent RNA polymerase (RDR6), and production of multiple perfectly phased ~21-nt small RNAs with perfectly matched duplexes with 2-nucleotide 3' overhangs (see Allen et al., 2005).

Many microRNA genes (MIR genes) have been identified and made publicly available in a database ("miRBase", available online at www.microrna.sanger.ac.uk/sequences; also see Griffiths-Jones et al. (2003)). Additional MIR genes and mature miRNAs are also described in U.S. Patent Application Publications 2005/0120415 and 2005/144669, which are incorporated by reference herein. MIR gene families appear to be substantial, estimated to account for 1% of at least some genomes and capable of influencing or regulating expression of about a third of all genes (see, for example, Tomari et al. (2005); Tang (2005); and Kim (2005)). MIR genes have been reported to occur in intergenic regions, both isolated and in clusters in the genome, but can also be located entirely or partially within introns of other genes (both protein-coding and non-protein-coding). For a recent review of miRNA biogenesis, see Kim (2005). Transcription of MIR genes can be, at least in some cases, under control of a MIR gene's own promoter. The primary transcript, termed a "pri-miRNA", can be quite large (several kilobases) and can be polycistronic, containing one or more pre-miRNAs (fold-back structures containing a stem-loop arrangement that is processed to the mature miRNA) as well as the usual 5' "cap" and polyadenylated tail of an mRNA. See, for example, FIG. 1 in Kim (2005).

A "phased small RNA locus," which transcribes to an RNA transcript forming a single foldback structure that is cleaved in phase in vivo into multiple small double-stranded RNAs (termed "phased small RNAs") capable of suppressing a target gene may also be employed (e.g. U.S. Patent Application Publication 20080066206). In contrast to siRNAs, a phased small RNA transcript is cleaved in phase. In contrast to miRNAs, a phased small RNA transcript is cleaved by DCL4 or a DCL4-like orthologous ribonuclease (not DCL1) to produce multiple abundant small RNAs capable of silencing a target gene. In contrast to the ta-siRNA pathway, the phased small RNA locus transcribes to an RNA transcript that forms hybridized RNA independently of an RNA-dependent RNA polymerase and without a miRNA target site that initiates production of double-stranded RNA. Novel recombinant DNA constructs that are designed based on a phased small RNA locus are useful for suppression of one or multiple target genes, without the use of miRNAs, ta-siRNAs, or expression vectors designed to form a hairpin structure for processing to siRNAs. Furthermore, the recognition sites corresponding to a phased small RNA are useful for suppression of a target sequence in a cell or tissue where the appropriate phased small RNA is expressed endogenously or as a transgene.

A. Virus Targets

In accordance with the invention, methods and compositions are provided for conferring resistance to multiple viruses to plants, including Solanaceous plants such as tomatoes. Viruses to which resistance may be targeted in the present invention include, without limitation, two or more viruses from among the *geminiviruses, tospovisues*, and *potexviruses*. FIG. 1 illustrates the genome organization of representatives of these viral genera.

1. Begomoviruses

The Geminiviridae are a large, diverse family of plant viruses that infect a broad variety of plants and cause significant crop losses worldwide. They are characterized by twin icosahedral capsids and circular ssDNA genomes that replicate through dsDNA intermediates. *Geminiviruses* ("*begomovirus*" and "*geminivirus*" are used interchangeably herein) depend on the plant nuclear DNA and RNA polymerases for replication and transcription. These viruses contribute only a few factors for their replication and transcription. The family Geminiviridae contains three main genera (formerly termed "subgroups") that differ with respect to insect vector, host range, and genome structure.

Geminiviridae Subgroup I (genus *Mastrevirus*) includes leafhopper-transmitted viruses that generally infect monocot plants and have single-component genomes.

Geminiviridae Subgroup III (genus *Begomovirus*) includes whitefly-transmitted viruses that infect dicot plants and most commonly have bipartite genomes.

Geminiviridae Subgroup II (genus *Curtovirus*) viruses are transmitted by leafhoppers and have single-component genomes like Subgroup I, but infect dicot plants like subgroup III.

2. Tospoviruses

Viruses in the genus *Tospovirus* cause significant worldwide crop losses. The genus name is derived from Tomato spotted wilt virus ("TSWV"). The Spotted Wilt Disease of tomato was first observed in Australia in 1915 and was later shown to be of viral origin. Until the early 1990s TSWV was considered to be the sole member of the tomato spotted wilt group of plant viruses. The identification and characterization of several similar viruses, including Impatiens necrotic spot virus (INSV), Capsicum chlorosis virus ("CaCV"), Peanut bud necrosis virus (also known as Groundnut bud necrosis virus, "GBNV"), and Tomato chlorotic spot virus led to the creation of the plant-infecting tospovirus genus within the Bunyaviridae family. This family includes a large group of predominantly animal-infecting viruses. More than twenty *tospoviruses* have since been identified and characterized and previously unknown species of the genus continue to be described on a regular basis.

*Tospoviruses* have a tripartite RNA genome of ambisense polarity. The three portions of the genome are termed the "L" segment, the "M" segment, and the "S" segment. A consensus terminal sequence of each portion of the RNA genome is found, defined by segments UCUCGUUAGC (SEQ ID NO:167) at the 3'end and AGAGCAAUCG (SEQ ID NO:168) at the 5'end. The largest RNA, the "L segment," encodes replicase. The medium size RNA, "M segment," encodes glycoproteins G1 and G2 in the complementary-sense RNA and a nonstructural protein, NSm, in the genome-sense RNA. The smallest segment, "S segment," encodes the nucleocapsid protein (N) in the complementary-sense RNA and a cell-to-cell movement, NSs, in the genome-sense RNA. The virus is transmitted by *thrips* in the genera *Frankliniella* (five species) and *Thrips* (three species). Mechanical transmission of the virus is also possible. TSWV can infect more than 925 plant species belonging to 70 botanical families, whereas the other *tospovirus* species have much narrower host ranges.

3. Potexviruses

The Pepino mosaic virus (PepMV) is a representative *potexvirus* from among the Flexiviridae, and is highly contagious with a significant potential to cause damage in protected tomato production. Significant crop losses are possible if action is not taken to eliminate infection. The virus is readily spread via contaminated tools, human hands or clothing, and by direct plant-to-plant contact. It can also be transmitted by grafting or when taking cuttings from infected mother plants. The use of coat protein-mediated resistance may provide good resistance. However, including inverted repeats to the CP may enhance resistant line production.

B. Nucleic Acid Compositions and Constructs

The invention provides recombinant DNA constructs and methods for use in achieving resistance to multiple (i.e. more than one) viral species and strains from among the *begomoviruses, tospoviruses*, and *potexviruses* in transgenic plants. In certain embodiments, resistance is conferred to 2, 3, 4, 5, 6, 7, 8, or more viral species selected from at least two of the following groups: *begomoviruses, tospoviruses*, and *potexviruses*. The resistance may be directed by production of siRNA or miRNA, and may also be complemented by protein based approaches such as resistance mediated by expressed coat protein or replicase, mutated forms of replicases, and production of aptamers. Genetically based tolerance (i.e. as identified in a classical breeding approach) may also be utilized.

As used herein, the term "nucleic acid" refers to a single or double-stranded polymer of deoxyribonucleotide or ribonucleotide bases read from the 5' to the 3' end. The "nucleic acid" may also optionally contain non-naturally occurring or altered nucleotide bases that permit correct read through by a polymerase and do not reduce expression of a polypeptide encoded by that nucleic acid. The term "nucleotide sequence" or "nucleic acid sequence" refers to both the sense and anti-sense strands of a nucleic acid as either individual single strands or in the duplex. The term "ribonucleic acid" (RNA)

is inclusive of dsRNA (double stranded RNA), siRNA (small interfering RNA), shRNA (small hairpin RNA), mRNA (messenger RNA), miRNA (microRNA), tRNA (transfer RNA, whether charged or discharged with a corresponding acylated amino acid), and cRNA (complementary RNA) and the term "deoxyribonucleic acid" (DNA) is inclusive of cDNA and genomic DNA and DNA-RNA hybrids. The words "nucleic acid segment," "nucleotide sequence segment," or more generally "segment" will be understood by those in the art as a functional term that includes both genomic sequences, ribosomal RNA sequences, transfer RNA sequences, messenger RNA sequences, operon sequences and smaller engineered nucleotide sequences that express or may be adapted to express, proteins, polypeptides or peptides.

As used herein, the term "substantially homologous" or "substantial homology," with reference to a nucleic acid sequence, includes a nucleotide sequence that hybridizes under stringent conditions to any of SEQ ID NOs:169-455, or a portion or complement thereof, are those that allow an antiparallel alignment to take place between the two sequences, and the two sequences are then able, under stringent conditions, to form hydrogen bonds with corresponding bases on the opposite strand to form a duplex molecule that is sufficiently stable under conditions of appropriate stringency, including high stringency, to be detectable using methods well known in the art. Substantially homologous sequences may have from about 70% to about 80% sequence identity, or more preferably from about 80% to about 85% sequence identity, or most preferable from about 90% to about 95% sequence identity, to about 99% sequence identity, to the referent nucleotide sequences as set forth the sequence listing, or the complements thereof.

As used herein, the term "ortholog" refers to a gene in two or more species that has evolved from a common ancestral nucleotide sequence, and may retain the same function in the two or more species.

As used herein, the term "sequence identity," "sequence similarity" or "homology" is used to describe sequence relationships between two or more nucleotide sequences. The percentage of "sequence identity" between two sequences is determined by comparing two optimally aligned sequences over a comparison window such as the full length of a referenced SEQ ID NO, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. A sequence that is identical at every position in comparison to a reference sequence is said to be identical to the reference sequence and vice-versa. A first nucleotide sequence when observed in the 5' to 3' direction is said to be a "complement" of, or complementary to, a second or reference nucleotide sequence observed in the 3' to 5' direction if the first nucleotide sequence exhibits complete complementarity with the second or reference sequence. As used herein, nucleic acid sequence molecules are said to exhibit "complete complementarity" when every nucleotide of one of the sequences read 5' to 3' is complementary to every nucleotide of the other sequence when read 3' to 5'. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

As used herein, a "comparison window" refers to a conceptual segment of at least 6 contiguous positions, usually about 50 to about 100, more usually about 100 to about 150, in which a sequence is compared to a reference sequence of the same number of contiguous positions after the two sequences are optimally aligned. The comparison window may comprise additions or deletions (i.e. gaps) of about 20% or less as compared to the reference sequence (which does not comprise additions or deletions) for optimal alignment of the two sequences Those skilled in the art should refer to the detailed methods used for sequence alignment, such as in the Wisconsin Genetics Software Package Release 7.0 (Genetics Computer Group, 575 Science Drive Madison, Wis., USA).

The present invention provides one or more DNA sequences capable of being expressed as an RNA transcript in a cell or microorganism to inhibit target gene expression of at least one plant virus. The sequences comprise a DNA molecule coding for one or more different nucleotide sequences, wherein each of the different nucleotide sequences comprises a sense nucleotide sequence and an antisense nucleotide sequence. The sequences may be connected by a spacer sequence. The spacer sequence can constitute part of the sense nucleotide sequence or the antisense nucleotide sequence or an unrelated nucleotide sequence and forms within the dsRNA molecule between the sense and antisense sequences. The spacer sequence may comprise, for example, a sequence of nucleotides of at least about 10-100 nucleotides in length, or alternatively at least about 100-200 nucleotides in length, at least 200-400 about nucleotides in length, or at least about 400-500 nucleotides in length. The sense nucleotide sequence or the antisense nucleotide sequence may be substantially identical to the nucleotide sequence of the target gene or a derivative thereof or a complementary sequence thereto. The dsDNA molecule may be placed operably under the control of one or more promoter sequences that function in the cell, tissue or organ of the host expressing the dsDNA to produce RNA molecules. As used herein, "expressing" or "expression" and the like refer to transcription of a RNA molecule from a transcribed polynucleotide. The RNA molecule may or may not be translated into a polypeptide sequence.

The invention also provides a DNA sequence for expression in a cell of a plant that, upon expression of the DNA to RNA and contact with a plant virus achieves suppression of a target viral gene or viral replication or symptomatology (i.e. expression of symptoms). Methods to express a gene suppression molecule in plants are known (e.g. US Publication 2006/0200878 A1; US Publication 2006/0174380; US Publication 2008/0066206; Niu et al., 2006), and may be used to express a nucleotide sequence of the present invention.

Non-constitutive promoters suitable for use with recombinant DNA constructs of the invention include spatially specific promoters, developmentally specific promoters, and inducible promoters. Spatially specific promoters can include organelle-, cell-, tissue-, or organ-specific promoters (e.g., a plastid-specific, a root-specific, a pollen-specific, or a seed-specific promoter for suppressing expression of the first target RNA in plastids, roots, pollen, or seeds, respectively). In many cases a seed-specific, embryo-specific, aleurone-specific, or endosperm-specific promoter is especially useful. Developmentally specific promoters can include promoters that tend to promote expression during certain developmental stages in a plant's growth cycle, or at different seasons in a year. Inducible promoters include promoters induced by chemicals or by environmental conditions such as, but not limited to, biotic or abiotic stress (e.g., water deficit or drought, heat, cold, high or low nutrient or salt levels, high or low light levels, or pest or pathogen infection). Also of interest are microRNA promoters, especially those having a developmentally specific, spatially specific, or inducible expression pattern. An expression-specific promoter can also include promoters that are generally constitutively expressed but at differing degrees or "strengths" of expression, including promoters commonly regarded as "strong promoters" or as "weak promoters."

Thus, a gene sequence or fragment for plant virus control according to the invention may be cloned downstream of a promoter or promoters which are operable in a transgenic plant cell and therein expressed to produce mRNA in the transgenic plant cell that form dsRNA molecules. Numerous examples of plant expressible promoters are known in the art (e.g. CaMV 35S; FMV 35S; PC1SV (e.g. U.S. Pat. No. 5,850, 019); ScBV; AtAct7, among others). Promoters useful for expression of polypeptides in plants include those that are inducible, viral, synthetic, or constitutive as described in Odell et al. (1985), and/or promoters that are temporally regulated, spatially regulated, and spatio-temporally regulated. A number of organ-specific promoters have been identified and are known in the art (e.g. U.S. Pat. Nos. 5,110,732; 5,837,848; 5,459,252; 6,229,067; Hirel et al. 1992). The dsRNA molecules contained in plant tissues are expressed in a plant so that the intended suppression of the targeted virus gene expression is achieved. The cauliflower mosaic virus 35S promoter, an archetypal strong promoter common in transgenic plant applications, or a related promoter such as the E35S or the FMV promoter, may be employed for driving virus resistance genes. Promoters have also been identified that direct tissue specific gene expression.

A transgene transcription unit includes DNA sequence encoding a gene of interest. A gene of interest can include any coding or non-coding sequence from a virus species. Non-limiting examples of a non-coding sequence to be expressed by a transgene transcription unit include, but not limited to, 5' untranslated regions, promoters, enhancers, or other non-coding transcriptional regions, 3' untranslated regions, terminators, intron, microRNAs, microRNA precursor DNA sequences, small interfering RNAs, RNA components of ribosomes or ribozymes, small nucleolar RNAs, RNA aptamers capable of binding to a ligand, and other non-coding RNAs.

Non-limiting examples of a gene of interest further include, but are not limited to, translatable (coding) sequence, such as genes encoding transcription factors and genes encoding enzymes involved in the biosynthesis or catabolism of molecules of interest (such as amino acids, fatty acids and other lipids, sugars and other carbohydrates, biological polymers, and secondary metabolites including alkaloids, terpenoids, polyketides, non-ribosomal peptides, and secondary metabolites of mixed biosynthetic origin). A gene of interest can be a gene native to the cell (e.g., a plant cell) in which the recombinant DNA construct of the invention is to be transcribed, or can be a non-native gene. A gene of interest can be a marker gene, for example, a selectable marker gene encoding antibiotic, antifungal, or herbicide resistance, or a marker gene encoding an easily detectable trait (e.g., in a plant cell, phytoene synthase or other genes imparting a particular pigment to the plant), or a gene encoding a detectable molecule, such as a fluorescent protein, luciferase, or a unique polypeptide or nucleic acid "tag" detectable by protein or nucleic acid detection methods, respectively). Selectable markers are genes of interest of particular utility in identifying successful processing of constructs of the invention.

Genes of interest include those genes that may be described as "target genes." The target gene can include a single gene or part of a single gene that is targeted for suppression, or can include, for example, multiple consecutive segments of a target gene, multiple non-consecutive segments of a target gene, multiple alleles of a target gene, or multiple target genes from one or more species. The target gene can be translatable (coding) sequence, or can be non-coding sequence (such as non-coding regulatory sequence), or both. The transgene transcription unit can further include 5' or 3' sequence or both as required for transcription of the transgene. In other embodiments (e.g., where it is desirable to suppress a target gene across multiple strains or species, for instance of viruses), it may be desirable to design the recombinant DNA construct to be processed to a mature miRNA for suppressing a target gene sequence common to the multiple strains or species in which the target gene is to be silenced. Thus, the miRNA processed from the recombinant DNA construct can be designed to be specific for one taxon (for example, specific to a genus, family, but not for other taxa.

The nucleic acid molecules or fragments of the nucleic acid molecules or other nucleic acid molecules in the sequence listing are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the complement of another nucleic acid molecule if they exhibit complete complementarity. Two molecules are said to be "minimally complementary" if they can hybridize to one another with sufficient stability to permit them to remain annealed to one another under at least conventional "low-stringency" conditions. Similarly, the molecules are said to be complementary if they can hybridize to one another with sufficient stability to permit them to remain annealed to one another under conventional "high-stringency" conditions. Conventional stringency conditions are described by Sambrook, et al. (1989), and by Haymes et al. (1985).

Departures from complete complementarity are therefore permissible for, as long as such departures do not completely preclude the capacity of the molecules to form a double-stranded structure. Thus, in order for a nucleic acid molecule or a fragment of the nucleic acid molecule to serve as a primer or probe it needs only be sufficiently complementary in sequence to be able to form a stable double-stranded structure under the particular solvent and salt concentrations employed.

Appropriate stringency conditions that promote DNA hybridization are, for example, for applications requiring high selectivity, a relatively low salt and/or high temperature condition, such as provided by about 0.02 M to about 0.15 M NaCl at temperatures of about 50° C. to about 70° C. A high stringency condition, for example, is to wash the hybridization filter at least twice with high-stringency wash buffer (0.2×SSC or 1×SSC, 0.1% SDS, 65° C.). Other conditions, such as 6.0× sodium chloride/sodium citrate (SSC) at about 45° C., followed by a wash of 2.0×SSC at 50° C., are also known to those skilled in the art or can be found in Current Protocols in Molecular Biology (1989). For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed. A nucleic acid for use in the present invention may specifically hybridize to one or more of nucleic acid molecules from a plant virus selected from the group consisting of a *tospovirus*, a *begomovirus*, and a *potexvirus*, or complements thereof under such conditions. In specific embodiments, a nucleic acid for use in the present invention will exhibit at least from about 80%, or at least from about 90%, or at least from about 95%, or at least from about 98% or even about 100% sequence identity with one or more nucleic acid molecules as set forth in the sequence listing, or a complement thereof.

Nucleic acids of the present invention may also be synthesized, either completely or in part, especially where it is desirable to provide plant-preferred sequences, by methods known in the art. Thus, all or a portion of the nucleic acids of the present invention may be synthesized using codons preferred by a selected host. Species-preferred codons may be determined, for example, from the codons used most frequently in the proteins expressed in a particular host species. Other modifications of the nucleotide sequences may result in mutants having slightly altered activity.

DsRNA or siRNA nucleotide sequences comprise double strands of polymerized ribonucleotide and may include modifications to either the phosphate-sugar backbone or the nucleoside. Modifications in RNA structure may be tailored to allow specific genetic inhibition. In one embodiment, the dsRNA molecules may be modified through an enzymatic process so that siRNA molecules may be generated. Alternatively, a construct may be engineered to express a nucleotide segment for use in an miRNA- or siRNA-mediated resistance approach. The siRNA can efficiently mediate the down-regulation effect for some target genes in some pathogens. This enzymatic process may be accomplished by utilizing an RNAse III enzyme or a DICER enzyme, present in the cells of an insect, a vertebrate animal, a fungus or a plant in the eukaryotic RNAi pathway (Elbashir et al., 2001; Hamilton and Baulcombe, 1999). This process may also utilize a recombinant DICER or RNAse III introduced into the cells of a target insect through recombinant DNA techniques that are readily known to the skilled in the art. Both the DICER enzyme and RNAse III, being naturally occurring in a pathogen or being made through recombinant DNA techniques, cleave larger dsRNA strands into smaller oligonucleotides. The DICER enzymes specifically cut the dsRNA molecules into siRNA pieces each of which is about 19-25 nucleotides in length while the RNAse III enzymes normally cleave the dsRNA molecules into 12-15 base-pair siRNA. The siRNA molecules produced by the either of the enzymes have 2 to 3 nucleotide 3' overhangs, and 5' phosphate and 3' hydroxyl termini. The siRNA molecules generated by RNAse III enzyme are the same as those produced by Dicer enzymes in the eukaryotic RNAi pathway and are hence then targeted and degraded by an inherent cellular RNA-degrading mechanism after they are subsequently unwound, separated into single-stranded RNA and hybridize with the RNA sequences transcribed by the target gene. This process results in the effective degradation or removal of the RNA sequence encoded by the nucleotide sequence of the target gene in the pathogen. The outcome is the silencing of a particularly targeted nucleotide sequence within the pathogen. Detailed descriptions of enzymatic processes can be found in Hannon (2002).

A nucleotide sequence of the present invention can be recorded on computer readable media. As used herein, "computer readable media" refers to any tangible medium of expression that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; optical character recognition formatted computer files, and hybrids of these categories such as magnetic/optical storage media. A skilled artisan can readily appreciate that any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII text file, stored in a database application, such as DB2, Sybase, Oracle, or the like. The skilled artisan can readily adapt any number of data processor structuring formats (e.g. text file or database) in order to obtain computer readable medium having recorded thereon the nucleotide sequence information of the present invention.

Computer software is publicly available which allows a skilled artisan to access sequence information provided in a computer readable medium. Software that implements the BLAST (Altschul et al., 1990) and BLAZE (Brutlag, et al., 1993) search algorithms on a Sybase system can be used to identify open reading frames (ORFs) within sequences such as the Unigenes and EST's that are provided herein and that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

As used herein, a "target," a "target structural motif," or a "target motif," refers to any rationally selected sequence or combination of sequences in which the sequences or sequence(s) are chosen based on a three-dimensional configuration that is formed upon the folding of the target motif or the nucleotide sequence thereof, as appropriate. There are a variety of target motifs known in the art.

C. Nucleic Acid Expression and Target Gene Suppression

The present invention provides, as an example, a transformed host plant of a pathogenic target organism, transformed plant cells and transformed plants and their progeny. The transformed plant cells and transformed plants may be engineered to express one or more of the dsRNA, miRNA, or mRNA sequences, under the control of a heterologous promoter, described herein to provide a pathogen-protective effect. These sequences may be used for gene suppression in a pathogen, thereby reducing the level or incidence of disease caused by the pathogen on a protected transformed host organism. As used herein the words "gene suppression" are intended to refer to any of the well-known methods for reducing the levels of protein produced as a result of gene transcription to mRNA and subsequent translation of the mRNA.

Gene suppression is also intended to mean the reduction of protein expression from a gene or a coding sequence including posttranscriptional gene suppression and transcriptional suppression. Posttranscriptional gene suppression is mediated by the homology between of all or a part of a mRNA transcribed from a gene or coding sequence targeted for suppression and the corresponding double stranded RNA used for suppression, and refers to the substantial and measurable reduction of the amount of available mRNA available in the cell for binding by ribosomes or the prevention of translation by the ribosomes. The transcribed RNA can be in the sense orientation to effect what is called co-suppression, in the anti-sense orientation to effect what is called anti-sense suppression, or in both orientations producing a dsRNA to effect what is called RNA interference (RNAi).

Gene suppression can also be effective against target genes in a plant virus that may contact plant material containing gene suppression agents, specifically designed to inhibit or suppress the expression of one or more homologous or complementary sequences of the virus. Post-transcriptional gene suppression by anti-sense or sense oriented RNA to regulate gene expression in plant cells is disclosed in U.S. Pat. Nos. 5,107,065, 5,759,829, 5,283,184, and 5,231,020. The use of dsRNA to suppress genes in plants is disclosed in WO 99/53050, WO 99/49029, U.S. Publication No. 2003/017596, U.S. Patent Application Publication 2004/0029283.

A beneficial method of post transcriptional gene suppression versus a plant virus employs both sense-oriented and anti-sense-oriented, transcribed RNA which is stabilized, e.g., as a hairpin or stem and loop structure (e.g. U.S. Publication 2007/0259785). A DNA construct for effecting post transcriptional gene suppression may be one in which a first segment encodes an RNA exhibiting an anti-sense orientation exhibiting substantial identity to a segment of a gene targeted for suppression, which is linked to a second segment encoding an RNA exhibiting substantial complementarity to the first segment. Such a construct forms a stem and loop structure by hybridization of the first segment with the second segment and a loop structure from the nucleotide sequences linking the two segments (see WO94/01550, WO98/05770, US 2002/0048814, and US 2003/0018993). Co-expression with an additional target gene segment may also be employed, as noted above (e.g. WO05/019408).

According to one embodiment of the present invention, there is provided an exogenous nucleotide sequence (i.e. not naturally found in the genome of the host plant cell), for which expression results in transcription of a RNA sequence that is substantially similar in sequence to a RNA molecule of a targeted gene of a plant virus, selected from the group consisting of a *tospovirus*, a *begomovirus*, and a *potexvirus*, that comprises an RNA sequence encoded by a nucleotide sequence within the genome of the virus. By substantially similar is meant that the exogenous RNA sequence is capable of effecting RNA-mediated gene suppression of a target sequence in a viral genome. Thus, a down-regulation of the expression of the nucleotide sequence corresponding to the target gene is effected.

In certain embodiments of the invention, expression of a fragment of at least 21 contiguous nucleotides of a nucleic acid sequence of any of SEQ ID NOs:169-455, or complements thereof, may be utilized, including expression of a fragment of up to 21, 36, 60, 100, 550, or 1000 contiguous nucleotides, or sequences displaying 90-100% identity with such sequences, or their complements. In specific embodiments, a nucleotide provided by the invention may comprise a sequence selected from among SEQ ID NOs: 1, 7, 13, 19, 25, 31, 37, 43, 47, 51, 55, 59, 63, 67, 71, 85, 99, 113, 127, and 141. In other specific embodiments, a nucleotide provided by the invention may comprise a sequence selected from among SEQ ID NOs: 379-455. In yet other embodiments, a nucleotide provided by the invention may be described as comprising one or more of nucleotides 1-21, 22-50, 51-100, 101-150, 151-200, 201-250, 251-300, 301-350, 351-400, 401-450, 451-500, 501-550, 551-600, 601-650, 651-700, 701-750, 751-800, 801-850, 851-900, 901-950, 951-1000, 1001-1050, 1051-1100, 1101-1150, 1151-1200, 1201-1250, 1251-1300, 1301-1350, 1351-1400, 1401-1450, 1451-1500, 1501-1550, 1551-1600, 1601-1650, 1651-1700, 1701-1750, 1751-1800, 1801-1850, 1851-1900, 1901-1950, 1951-2000, 2001-2050, 2051-2100, 23-75, 76-125, 126-175, 176-225, 226-275, 276-325, 326-375, 376-425, 426-475, 476-525, 526-575, 576-625, 626-675, 676-725, 726-775, 776-825, 826-875, 876-925, 926-975, 976-1025, 1026-1075, 1076-1125, 1126-1175, 1176-1225, 1226-1275, 1276-1325, 1326-1375, 1376-1425, 1426-1475, 1476-1525, 1526-1575, 1576-1625, 1626-1675, 1676-1725, 1726-1775, 1776-1825, 1826-1875, 1876-1925, 1926-1975, 1976-2025, 2026-2075, 2076-2125, 1-550, 200-750, 300-850, 400-950, 500-1050, 600-1150, 700-1250, 800-1350, 900-1450, 1000-1550, 1100-1650, 1200-1750, 1300-1850, 1400-1950, 1500-2050, up to the full length of the sequence, of one or more of any of SEQ ID NOs:169-455. A sequence complementary to all or a portion of any one or more of SEQ ID NOs:169-455, or SEQ ID NOs: 1, 7, 13, 19, 25, 31, 37, 43, 47, 51, 55, 59, 63, 67, 71, 85, 99, 113, 127, and 141, wherein expression of said sequence suppresses the expression of any one or more of gene(s) encoded by a nucleotide sequence of SEQ ID NOs:169-455, is contemplated. The sequences arrayed for expression to produce dsRNA can be combined with: (1) sequences designed for production of miRNA, including in stacked miRNA cassettes; and/or (2) sequences for inhibition of viral assembly, in order to synergistically inhibit target viruses. Methods for selecting specific sub-sequences as targets for miRNA or siRNA-mediated gene suppression are known in the art (e.g. Reynolds et al., 2004).

Inhibition of a target gene using dsRNA technology of the present invention is sequence-specific in that nucleotide sequences corresponding to the duplex region of the RNA are targeted for suppression. RNA containing a nucleotide sequences identical to a portion of the target gene transcript is usually preferred for inhibition. RNA sequences with insertions, deletions, and single point mutations relative to the target sequence have also been found to be effective for inhibition. In performance of the present invention, the inhibitory dsRNA and the portion of the target gene may share at least from about 80% sequence identity, or from about 90% sequence identity, or from about 95% sequence identity, or from about 99% sequence identity, or even about 100% sequence identity. Alternatively, the duplex region of the RNA may be defined functionally as a nucleotide sequence that is capable of hybridizing with a portion of the target gene transcript. A less than full length sequence exhibiting a greater homology compensates for a longer less homologous sequence. The length of the identical nucleotide sequences may be at least about 18, 21, 25, 50, 100, 200, 300, 400, 500 or at least about 1000 bases. Normally, a sequence of greater than 20-100 nucleotides should be used, though a sequence of greater than about 200-300 nucleotides may be preferred, and a sequence of greater than about 500-1000 nucleotides may be especially preferred depending on the size of the target gene. The invention has the advantage of being able to tolerate sequence variations that might be expected due to genetic mutation, strain polymorphism, or evolutionary divergence. The introduced nucleic acid molecule may not need to be absolutely homologous to the target sequence, and it may not need to be full length relative to either the primary transcription product or fully processed mRNA of the target gene. Therefore, those skilled in the art need to realize that, as disclosed herein, 100% sequence identity between the RNA and the target gene is not required to practice the present invention.

Inhibition of target gene expression may be quantified by measuring either the endogenous target RNA or the protein produced by translation of the target RNA and the consequences of inhibition can be confirmed by examination of the outward properties of the cell or organism. Techniques for quantifying RNA and proteins are well known to one of ordinary skill in the art.

In certain embodiments gene expression is inhibited by at least 10%, by at least 33%, by at least 50%, or by at least 80%. In particular embodiments of the invention gene expression is inhibited by at least 80%, by at least 90%, by at least 95%, or by at least 99% within host cells infected by the virus, such a significant inhibition takes place. Significant inhibition is intended to refer to sufficient inhibition that results in a detectable phenotype (e.g., reduction of symptom expression, etc.) or a detectable decrease in RNA and/or protein corresponding to the target gene being inhibited.

DsRNA molecules may be synthesized either in vivo or in vitro. The dsRNA may be formed by a single self-complementary RNA strand or from two complementary RNA strands. Endogenous RNA polymerase of the cell may mediate transcription in vivo, or cloned RNA polymerase can be used for transcription in vivo or in vitro. Inhibition may be targeted by specific transcription in an organ, tissue, or cell type; stimulation of an environmental condition (e.g., infection, stress, temperature, chemical inducers); and/or engineering transcription at a developmental stage or age. The RNA strands may or may not be polyadenylated; the RNA strands may or may not be capable of being translated into a polypeptide by a cell's translational apparatus.

As used herein, the term "disease control agent," or "gene suppression agent" refers, in certain embodiments, to a particular RNA molecule consisting of a first RNA segment and a second RNA segment linked by a third RNA segment. The first and the second RNA segments lie within the length of the RNA molecule and are substantially inverted repeats of each other and are linked together by the third RNA segment. The complementarity between the first and the second RNA segments results in the ability of the two segments to hybridize in vivo and in vitro to form a double stranded molecule, i.e., a stem, linked together at one end of each of the first and second segments by the third segment which forms a loop, so that the entire structure forms into a stem and loop structure, or even more tightly hybridizing structures may form into a stem-loop knotted structure. The first and the second segments correspond invariably, but not necessarily respectively, to a sense and an antisense sequence homologous with respect to the target RNA transcribed from the target gene in the target virus that is intended to be suppressed by the dsRNA molecule.

As used herein, the term "genome" as it applies to a plant virus or a host encompasses not only viral DNA or RNA, or chromosomal DNA found within the nucleus, but organelle DNA found within subcellular components of the cell. The DNA's of the present invention introduced into plant cells can therefore be either chromosomally integrated or organelle-localized. The term "genome" as it applies to bacteria encompasses both the chromosome and plasmids within a bacterial host cell. The DNA's of the present invention introduced into bacterial host cells can therefore be either chromosomally integrated or plasmid-localized.

It is envisioned that the compositions of the present invention can be incorporated within the seeds of a plant species either as a product of expression from a recombinant gene incorporated into a genome of the plant cells. The plant cell containing a recombinant gene is considered herein to be a transgenic event.

D. Recombinant Vectors and Host Cell Transformation

A recombinant DNA vector may, for example, be a linear or a closed circular plasmid. The vector system may be a single vector or plasmid or two or more vectors or plasmids that together contain the total DNA to be introduced into the genome of the bacterial host. In addition, a bacterial vector may be an expression vector. Nucleic acid molecules as set forth in the sequence listing, or complements or fragments thereof, can, for example, be suitably inserted into a vector under the control of a suitable promoter that functions in one or more microbial hosts to drive expression of a linked coding sequence or other DNA sequence. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

Expression and cloning vectors generally contain a selection gene, also referred to as a selectable marker. This gene encodes a protein necessary for the survival or growth of transformed host cells grown in a selective culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for *Bacilli*. Those cells that are successfully transformed with a heterologous protein or fragment thereof produce a protein conferring drug resistance and thus survive the selection regimen.

An expression vector for producing a mRNA can also contain an inducible promoter that is recognized by a host organism and is operably linked to the nucleic acid. The term "operably linked," as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream (5' noncoding sequences), within, or downstream (3' non-translated sequences) of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, and polyadenylation recognition sequences and the like.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a nucleic acid, or fragment thereof may be ligated into the vector in frame with sequences for the amino-terminal Met and the subsequent 7 residues of β-galactosidase so that a hybrid protein is produced; pIN vectors (Van Heeke and Schuster, 1989); and the like.

The present invention also contemplates transformation of a nucleotide sequence of the present invention into a plant to achieve virus-inhibitory levels of expression of one or more RNA molecules. A transformation vector can be readily prepared using methods available in the art. The transformation vector comprises one or more nucleotide sequences that is/are capable of being transcribed to an RNA molecule and that is/are substantially homologous and/or complementary to one or more nucleotide sequences encoded by the genome of the target virus or viruses, such that upon contact of the RNA transcribed from the one or more nucleotide sequences by the target plant-parasitic virus, there is down-regulation of expression of at least one of the respective nucleotide sequences of the genome of the virus.

The transformation vector may be termed a dsDNA construct and may also be defined as a recombinant molecule, a disease control agent, a genetic molecule or a chimeric genetic construct. A chimeric genetic construct of the present invention may comprise, for example, nucleotide sequences encoding one or more antisense transcripts, one or more sense transcripts, one or more of each of the aforementioned, wherein all or part of a transcript there from is homologous to all or part of an RNA molecule comprising an RNA sequence encoded by a nucleotide sequence within the genome of a plant virus.

In one embodiment a plant transformation vector comprises an isolated and purified DNA molecule comprising a heterologous promoter operatively linked to one or more nucleotide sequences of the present invention. The nucleotide sequence includes a segment coding all or part of an RNA present within a targeted RNA transcript and may comprise inverted repeats of all or a part of a targeted RNA. The DNA molecule comprising the expression vector may also contain a functional intron sequence positioned either upstream of the coding sequence or even within the coding sequence, and may also contain a five prime (5') untranslated leader sequence (i.e., a UTR or 5'-UTR) positioned between the promoter and the point of translation initiation.

A plant transformation vector may contain sequences from more than one gene, thus allowing production of more than one dsRNA, miRNA, or siRNA for inhibiting expression of genes of the more than one target virus. For instance a vector or construct may comprise up to about 8 or 10, or more, nucleic acid segments for transcription of antiviral sequences, as shown in FIG. 10. One skilled in the art will readily appreciate that segments of DNA whose sequence corresponds to that present in different genes can be combined into a single composite DNA segment for expression in a transgenic plant. Alternatively, a plasmid of the present invention already containing at least one DNA segment can be modified by the sequential insertion of additional DNA segments between the enhancer and promoter and terminator sequences. In the disease control agent of the present invention designed for the inhibition of multiple genes, the genes to be inhibited can be obtained from the same plant viral strain or species in order to enhance the effectiveness of the control agent. In certain embodiments, the genes can be derived from different plant viruses in order to broaden the range of viruses against which the agent(s) is/are effective. When multiple genes are targeted for suppression or a combination of expression and suppression, a polycistronic DNA element can be fabricated as illustrated and disclosed in U.S. Publication No. 2004/0029283.

A recombinant DNA vector or construct of the present invention may comprise a selectable marker that confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene which codes for kanamycin resistance and can be selected for using kanamycin, G418, etc., a bar gene which codes for bialaphos resistance; a mutant EPSP synthase gene which encodes glyphosate resistance; a nitrilase gene which confers resistance to bromoxynil; a mutant acetolactate synthase gene (ALS) which confers imidazolinone or sulfonylurea resistance; and a methotrexate resistant DHFR gene. Multiple selectable markers are available that confer resistance to ampicillin, bleomycin, chloramphenicol, gentamycin, hygromycin, kanamycin, lincomycin, methotrexate, phosphinothricin, puromycin, spectinomycin, rifampicin, and tetracycline, and the like. Examples of such selectable markers are illustrated in U.S. Pat. Nos. 5,550,318; 5,633,435; 5,780,708 and 6,118,047.

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson et al., 1987); one or more of the various fluorescent proteins (FP) genes such as green fluorescent protein (GFP), red fluorescent protein (RFP) or any one of a large family of proteins which typically fluoresce at a characteristic wavelength; an R-locus gene, which encodes a product that regulates the production of anthocyanin pigments (red color) in plant tissues (Dellaporta et al., 1988); a β-lactamase gene (Sutcliffe et al., 1978), a gene which encodes an enzyme for which various chromogenic substrates are known (e.g., PADAC, a chromogenic cephalosporin); a luciferase gene (Ow et al., 1986) a xylE gene (Zukowski et al., 1983) which encodes a catechol dioxygenase that can convert chromogenic catechols; an α-amylase gene (Ikatu et al., 1990); a tyrosinase gene (Katz et al., 1983) which encodes an enzyme capable of oxidizing tyrosine to DOPA and dopaquinone which in turn condenses to melanin; an α-galactosidase, which catalyzes a chromogenic α-galactose substrate.

Plant transformation vectors for use with the present invention may for instance include those derived from a Ti plasmid of *Agrobacterium tumefaciens* (e.g. U.S. Pat. Nos. 4,536,475, 4,693,977, 4,886,937, 5,501,967 and EP 0 122 791). *Agrobacterium rhizogenes* plasmids (or "Ri") are also useful and known in the art. Other preferred plant transformation vectors include those disclosed, e.g., by Herrera-Estrella (1983); Bevan (1983), Klee (1985) and EP 0 120 516.

In certain embodiments, a functional recombinant DNA may be introduced at a non-specific location in a plant genome. In special cases it may be useful to insert a recombinant DNA construct by site-specific integration. Several site-specific recombination systems exist which are known to function in plants include cre-lox as disclosed in U.S. Pat. No. 4,959,317 and FLP-FRT as disclosed in U.S. Pat. No. 5,527,695.

Suitable methods for transformation of host cells for use with the current invention are believed to include virtually any method by which DNA can be introduced into a cell (see, for example, Miki et al., 1993), such as by transformation of protoplasts (U.S. Pat. No. 5,508,184; Omirulleh et al., 1993), by desiccation/inhibition-mediated DNA uptake (Potrykus et al., 1985), by electroporation (U.S. Pat. No. 5,384,253), by agitation with silicon carbide fibers (Kaeppler et al., 1990; U.S. Pat. No. 5,302,523; and U.S. Pat. No. 5,464,765), by Agrobacterium-mediated transformation (U.S. Pat. Nos. 5,563,055; 5,591,616; 5,693,512; 5,824,877; 5,981,840; 6,384,301) and by acceleration of DNA coated particles (U.S. Pat. Nos. 5,015,580; 5,550,318; 5,538,880; 6,160,208; 6,399,861; 6,403,865; Padgette et al. 1995), etc. Through the application of techniques such as these, the cells of virtually any species may be stably transformed. In the case of multicellular species, the transgenic cells may be regenerated into transgenic organisms.

The most widely utilized method for introducing an expression vector into plants is based on the natural transformation system of Agrobacterium (for example, Horsch et al., 1985). A. tumefaciens and A. rhizogenes are plant pathogenic soil bacteria which genetically transform plant cells. The Ti and Ri plasmids of A. tumefaciens and A. rhizogenes, respectively, carry genes responsible for genetic transformation of the plant. Descriptions of Agrobacterium vector systems and methods for Agrobacterium-mediated gene transfer are provided by numerous references, including Gruber et al. 1993; Miki et al., 1993, Moloney et al., 1989, and U.S. Pat. Nos. 4,940,838 and 5,464,763. Other bacteria such as Sinorhizobium, Rhizobium, and Mesorhizobium that interact with plants naturally can be modified to mediate gene transfer to a number of diverse plants. These plant-associated symbiotic bacteria can be made competent for gene transfer by acquisition of both a disarmed Ti plasmid and a suitable binary vector (Broothaerts et al., 2005). Methods for introducing virus sequences to plants may also be used (e.g. Grimsley, 1990, Boulton, 1996).

Methods for the creation of transgenic plants and expression of heterologous nucleic acids in plants in particular are known and may be used with the nucleic acids provided herein to prepare transgenic plants that exhibit reduced susceptibility to plant-pathogenic viruses. Plant transformation vectors can be prepared, for example, by inserting the dsRNA producing nucleic acids disclosed herein into plant transformation vectors and introducing these into plants. One known vector system has been derived by modifying the natural gene transfer system of Agrobacterium tumefaciens. The natural system comprises large Ti (tumor-inducing)-plasmids containing a large segment, known as T-DNA, which is transferred to transformed plants. Another segment of the Ti plasmid, the vir region, is responsible for T-DNA transfer. The T-DNA region is bordered by terminal repeats. In the modified binary vectors the tumor-inducing genes have been deleted and the functions of the vir region are utilized to transfer foreign DNA bordered by the T-DNA border sequences. The T-region may also contain a selectable marker for efficient recovery of transgenic plants and cells, and a multiple cloning site for inserting sequences for transfer such as a dsRNA encoding nucleic acid.

Protocols for transformation of tomato cells are known in the art (e.g. McCormick, 1991). Alternate plant transformation protocols are discussed in Boulton (1996), and Grimsley (1990). Transformation and regeneration protocols for other plants, such as pepper, are known in the art (e.g. Christopher and Rajam, 1996; U.S. Pat. No. 5,262,316; Liu et al. 1990). For instance, such a protocol for transformation of tomato could include well known steps of seed sterilization, seed germination and growth, explanting of seedlings, Agrobacterium culture growth and preparation, co-cultivation, selection, and regeneration.

E. Transgenic Plants and Cells

A transgenic plant formed using Agrobacterium transformation methods typically may contain a single simple recombinant DNA sequence inserted into one chromosome, referred to as a transgenic event. Such transgenic plants can be referred to as being heterozygous for the inserted exogenous sequence. A transgenic plant homozygous with respect to a transgene can be obtained by sexually mating (selfing) an independent segregant transgenic plant that contains a single exogenous gene sequence to itself, for example an F0 plant, to produce F1 seed. One fourth of the F1 seed produced will be homozygous with respect to the transgene. Germinating F1 seed results in plants that can be tested for heterozygosity, typically using a SNP assay or a thermal amplification assay that allows for the distinction between heterozygotes and homozygotes (i.e., a zygosity assay). Crossing a heterozygous plant with itself or another heterozygous plant results in heterozygous progeny, as well as homozygous transgenic and homozygous null progeny.

In addition to direct transformation of a plant with a recombinant DNA construct, transgenic plants can be prepared by crossing a first plant having a recombinant DNA construct with a second plant lacking the construct. For example, recombinant DNA for gene suppression can be introduced into first plant line that is amenable to transformation to produce a transgenic plant that can be crossed with a second plant line to introgress the recombinant DNA for gene suppression into the second plant line.

F. Virus Resistance Screens

Inoculation and disease testing with viruses such as TSWV, TYLCV, and PepMV was performed using either mechanical transmission or agroinfection (e.g. Boulton, 1996; Grimsley, 1990). TSWV infection was accomplished mechanically, essentially as described by Kumar et al., (1993) with some modifications. Inoculation with begomovirus (e.g. TYLCV) and disease testing of plants was accomplished by agroinfection as follows: Seeds of tomato (Lycopersicon esculentum) cvs. (Resistant (R): HP919; Intermediate Resistant (IR): Hilario; Susceptible (S): Arletta) were sown and approximately 20 plants for each inoculation, as well as a non-inoculated or mock-inoculated control, were grown for 7-10 days, to the cotyledon stage with no primary leaf visible. The lower sides of the cotyledons were then infiltrated using a needleless syringe, and additional inoculations were subsequently performed by injection into stems at the 2-3 true leaf stage, approximately 1-2 weeks later. Infiltration or injection utilized a transformed A. tumefaciens strain, induced with acetosyringone, containing an infections clone of the virus that had been grown in YEB broth with antibiotics for selection of the pBIN vector for about 15 hours at 28° C. on a shaker (170 RPM) from inoculation of a fresh culture. Following growth at 28° C., the culture was spun down and resuspended in 10 ml MMA (Per 1 liter: 20 g sucrose, 5 g MS salts, 1.95 g MES, pH 5.6 with NaOH, and 1 ml of 200 mM acetosyringone stock; $dH_2O$ to 1 liter). Plants were grown at 20-25° C. (day/night), 16 hours light in the greenhouse or growth chamber. After 6 weeks, symptoms were scored as follows:

1 no symptoms visible (resistant)
3. very mild symptoms (resistant)
5. medium symptoms
7. strong symptoms
9. very strong symptoms Inoculation with the *potexvirus* Pepino mosaic virus (PepMV) was accomplished as follows: Virus inoculum was prepared by mechanically infecting tomato seedlings (susceptible cv. Apollo, 9-12 days old) following dusting of leaves with carborundum powder. Infected tissues were harvested and 1 g of infected tissue was homogenized with 5-10 ml of phosphate buffer (pH 9). This prepared inoculum was then used to mechanically inoculate experimental plants at the cotyledon stage (7-10 days after sowing). Inoculated plants were grown in the greenhouse at 19-23° C. (day/night), with 16 hours of light per 24 hours, in greenhouse with 70% relative humidity. Plants were evaluated at 11-21 days after inoculation, and scored as follows:

1 no symptoms visible (resistant)
3. some foliar chlorosis
5. chlorosis in foliar veins and/or foliar mosaic
7. foliar vein chlorosis and spiky leaves
9. foliar vein chlorosis and spiky leaves and yellow mosaic G. RNA Extraction and siRNA Northern Blots RNA was extracted for small RNA northern blotting using Trizol® essentially according to the manufacturer's directions (Invitrogen). Briefly, approximately 100-200 mg of fresh leaf tissue was ground in liquid nitrogen in 1.5 ml centrifuge tube placed on dry ice. Sample was removed from dry ice and 1 ml of Trizol was added under a fume hood. This was mixed well and incubated at room temperature (RT) for 10 minutes. Next, 0.2 ml of chloroform was added, and the sample was shaken by hand for 30 seconds and centrifuged at 13000 rpm in a refrigerated table top centrifuge for 15 minutes at 4° C.

The aqueous phase was transferred to a new tube, 0.5 ml of isopropanol was added, and tubes were inverted a few times, and then incubated for 10 min at RT followed by centrifugation at 13000 rpm in a refrigerated table top centrifuge for 15 min at 4° C. The supernatant was discarded and the pellet was washed by adding 0.75 ml of 75% ethanol, then centrifuged at 13000 rpm for 10 min at 4° C. The supernatant was discarded and RNA was air dried for 10 minutes at room temperature.

The pellet was resuspended by adding 100 μl of RNAse free ddH2O and was vortexed for a few seconds. The samples were frozen on dry ice and the RNA concentrated by the use of a speed vacuum for about 20 minutes: this step removes all traces of ethanol. RNA was quantified by spectrophotometer (usually about 80-100 μg are recovered from tomato leaf). About 7 μg of total RNA were loaded for siRNA analysis.

siRNA Northern Blot with DIG Labeled Probe:

Pre-run the 15% TBE-Urea gel (Invitrogen EC68855BOX) for about 30' at 110 volts. Samples were prepared for loading by adding 7 μl of Novex® TBE-Urea Sample Buffer 2× (Invitrogen LC6876) to 7 μl of total RNA (5-7 μg), they are denatured for about 10' at 94° C. and immediately cooled on ice. If sample visualization under UV light was needed, ethidium bromide was added to the sample buffer (1 μl of EtBr @0.624 mg/ml for every 100 μl of buffer). Samples were briefly spun down before loading into the gel wells and electrophoresis was carried on for about 1.5 hrs at 180 Volts in 0.5×TBE until the blue dye reached the bottom of the gel. After the run was terminated, the gel was observed under UV lights.

Transfer of the Gel to Nytran Supercharge Nylon Membrane (VWR 28151-318) was done in a Transblot semi dry transfer cell (BioRad 170-3940): the membrane was pre-wet in water and equilibrated in 0.5×TBE together with 2 pieces of extra-thick paper (BioRad 170-3968). The transfer was set up according to manufacturer's instruction (anode-blotting paper-membrane-gel-blotting paper-cathode) and carried on for 50' at 380 mAmp. After transfer the membrane was left to air dry for about 10' and then the RNA was cross-linked to it in a Stratalinker 1800 (Stratagene).

Hybridization:

The membrane was pre-hybridized at 42° C. for 1 hr with 10 ml of PerfectHyb solution (Sigma H7033) in a hybridization oven. 200 ng of DIG labeled probe, prepared with the PCR DIG labeling mix (Roche 11585550910) following manufacturer's instruction, was denatured for 10' at 94° C., cooled on ice, and added to 10 ml of fresh hybridization solution, which was added to the pre-hybridized membrane and incubated overnight at 42° C. in the hybridization oven.

Washes and Detection:

After discarding the hybridization solution, the membranes was briefly rinsed in 2×SSC 0.1% SDS; and then washed 2 times in pre-warmed 2×SSC 0.1% SDS for 20' at 50° C., 2 times in pre-warmed 1×SSC 0.1% SDS for 20' at 50° C., 2 times in pre-warmed 0.5×SSC 0.1% SDS for 20' at 50° C. Detection was performed following the instructions provided with the DIG Wash and Block Buffer Set (Roche 11585762001). Briefly, the membrane was rinsed for 2' in 1×DIG Washing Buffer before incubating for 1 hr at RT in 100 mL DIG Blocking Solution (10 mL 10× Blocking buffer+10 mL 10× Maleic Acid+80 mL water). It was then incubated for 1 hr at room temperature in 100 mL fresh DIG Blocking Solution to which 10 μl of Anti-Digoxigenin-AP antibody (Roche 11093274910) had been added. The membrane was washed 15' at RT twice 100 mL 1×DIG Washing Buffer and equilibrated with 100 mL of 1×DIG Detection Buffer. About 1 mL of CDP-star solution (Roche 12041677001) was distributed across the top of the membrane, which was placed between 2 plastic sheets, incubated at RT for 5' and exposed to a film for variable amounts of time before developing.

H. Validation of Constructs in Transgenic Tomato Plants

The engineered sequences for generating dsRNA or miRNA were cloned into binary vectors for tomato transformation. $R_0$ transgenic plants were assayed for the production of the specific ~21 mers and/or virus resistance efficacy by small RNA northern blot analysis and resistance assays as outlined above and as described in Example 7. Other selected dsRNA-generating sequences or miRNA-generating sequences, for instance from among any of SEQ ID NOs:1-154, or from within SEQ ID NOs:169-455 or portions thereof, may be utilized to create additional efficacious constructs. Thus, for instance, MIR backbone sequence(s), for instance MON1 from soybean, MON5 from soybean, MON13 from rice, MON18 from maize, miR159a from maize, or mi167g from maize (SEQ ID NOs:155, 157, 159, 161, 163, or 165) may be utilized to create dsRNA- or miRNA-generating sequence(s). In certain embodiments, the dsRNA-generating sequence or miRNA-generating sequence may comprise any of SEQ ID NOs:1, 7, 13, 19, 25, 31, 37, 43, 47, 55, 59, 63, 67, 71, 85, 99, 113, 127, 141, or 379-455. In particular embodiments, the sequence may comprise any of SEQ ID NOs:156, 158, 160, 162, 164, 166, 363, 364, 365, 366, 367, 368, 369, 370, 371, 372, 373, 374, or 375.

The present invention includes combinations with other disease control traits in a plant, including non-transgenic approaches, to achieve desired traits for enhanced control of plant disease. Combining disease control traits that employ distinct modes-of-action can provide protected transgenic plants with superior durability over plants harboring a single control trait because of the reduced probability that resistance will develop in the field. Thus, in certain embodiments, at least two or at least three modes of action are employed to confer virus resistance, wherein such modes of action are selected from the group consisting of expression of dsRNA, expression of miRNA, inhibition of virion assembly, phenotypic expression of a non-transgenic virus resistance trait, and transgenic protein expression. In particular embodiments, transgenic protein expression comprises expression of a coat protein-encoding nucleic acid sequence, expression of a movement protein-encoding sequence or expression of a replicase-encoding nucleic acid sequence.

The invention also relates to commodity products containing one or more of the sequences of the present invention, and produced from a recombinant plant or seed containing one or more of the nucleotide sequences of the present invention are specifically contemplated as embodiments of the present invention. A commodity product containing one or more of the sequences of the present invention is intended to include, but not be limited to, meals, oils, crushed or whole grains or seeds of a plant, or any food product comprising any meal, oil, or crushed or whole grain of a recombinant plant or seed containing one or more of the sequences of the present invention. The detection of one or more of the sequences of the present invention in one or more commodity or commodity products contemplated herein is defacto evidence that the commodity or commodity product is composed of a transgenic plant designed to express one or more of the nucleotides sequences of the present invention for the purpose of controlling plant disease using dsRNA mediated gene suppression methods.

I. Nucleic Acid Compositions

The present invention provides methods for obtaining a nucleic acid comprising a nucleotide sequence for producing a dsRNA, miRNA, or siRNA. In one embodiment, such a method comprises: (a) analyzing one or more target gene(s) for their expression, function, and phenotype upon dsRNA-mediated, or mi-RNA- or siRNA-mediated suppression of a gene of a plant pathogenic virus; (b) probing a nucleic acid library with a hybridization probe comprising all or a portion of a nucleotide sequence, or a homolog thereof, from a targeted virus that displays an altered phenotype in a dsRNA-mediated suppression analysis; (c) identifying a DNA clone that hybridizes with the hybridization probe; (d) isolating the DNA clone identified in step (b); and (e) sequencing the nucleic acid fragment that comprises the clone isolated in step (d) wherein the sequenced nucleic acid molecule transcribes all or a substantial portion of the RNA nucleotide acid sequence or a homolog thereof. The RNA-mediated resistance approach utilizing dsRNA, miRNA, or siRNA may be supplemented by placing antiviral sequences into the loop of a dsRNA-encoding sequence, or by inserting a sequence that encodes an efficacious dsRNA or miRNA into an intron of a polypeptide expression cassette (intronic dsRNA/miRNA; Frizzi et al., 2008) (e.g. FIG. 9). For example, viral protein(s) such as coat protein and/or replicase may be expressed in a transgenic plant that also expresses an efficacious dsRNA, miRNA, or siRNA, without use of an additional transgene cassette, by inserting protein coding sequence into the loop of a dsRNA.

In another embodiment, a method of the present invention for obtaining a nucleic acid fragment comprising a nucleotide sequence for producing a substantial portion of a dsRNA or siRNA comprises: (a) synthesizing a first and a second oligonucleotide primers corresponding to a portion of one of the nucleotide sequences from a targeted pathogen; and (b) amplifying a nucleic acid insert present in a cloning vector using the first and second oligonucleotide primers of step (a) wherein the amplified nucleic acid molecule transcribes a substantial portion of the a substantial portion of a dsRNA or siRNA of the present invention.

In practicing the present invention, target genes may be derived from a *begomovirus, tospovirus*, or *potexvirus*. It is contemplated that several criteria may be employed in the selection of preferred target genes. Such sequences may be identified by aligning, for instance, *begomovirus* or *tospovirus* sequences from multiple strains and/or species. A bioinformatics approach has identified numerous 21-mers that are mostly conserved in more than 100 *begomovirus* strains and species. In some instances, mismatches within a particular 21-mer are allowed for broader targeting.

As used herein, the term "derived from" refers to a specified nucleotide sequence that may be obtained from a particular specified source or species, albeit not necessarily directly from that specified source or species.

In one embodiment, a gene is selected that results in suppression of viral replication and/or symptomatology. Other target genes for use in the present invention may include, for example, those that play important roles in viral transmission, movement within a plant, or virion assembly (e.g. tospovirus terminal sequences, comprising the terminal repeat sequences). According to one aspect of the present invention for virus control, the target sequences may essentially be derived from the targeted plant viruses. Some of the exemplary target sequences cloned from a *begomovirus, tospovirus*, or *potexvirus* may be found in the Sequence Listing, for instance in SEQ ID NOs: 1, 7, 13, 19, 25, 31, 37, 43, 47, 51, 55, 59, 63, 67, 71, 85, 99, 113, 127, and 141, as well as within SEQ ID NOs:169-455.

For the purpose of the present invention, the dsRNA molecules may be obtained by polymerase chain (PCR) amplification of a target gene sequences derived from a gDNA or cDNA library or portions thereof. The DNA library may be prepared using methods known to the ordinary skilled in the art and DNA/RNA may be extracted. Genomic DNA or cDNA libraries generated from a target organism may be used for PCR amplification for production of the dsRNA or siRNA.

The target gene sequences may be then be PCR amplified and sequenced using the methods readily available in the art. One skilled in the art may be able to modify the PCR conditions to ensure optimal PCR product formation. The confirmed PCR product may be used as a template for in vitro transcription to generate sense and antisense RNA with the included minimal promoters. In one embodiment, the present invention comprises isolated and purified nucleotide sequences that may be used as plant-virus control agents. The isolated and purified nucleotide sequences may comprise those as set forth in the sequence listing.

As used herein, the phrase "coding sequence," "structural nucleotide sequence" or "structural nucleic acid molecule" refers to a nucleotide sequence that is translated into a polypeptide, usually via mRNA, when placed under the control of appropriate regulatory sequences. The boundaries of the coding sequence are determined by a translation start codon at the 5'-terminus and a translation stop codon at the 3'-terminus. A coding sequence can include, but is not limited to, genomic DNA, cDNA, EST and recombinant nucleotide sequences.

The term "recombinant DNA" or "recombinant nucleotide sequence" refers to DNA that contains a genetically engineered modification through manipulation via mutagenesis, restriction enzymes, and the like.

EXAMPLES

The inventors herein have identified a means for controlling virus infections in plants by incorporating into plants engineered miRNAs, ta-siRNAs and/or phased siRNAs. Any one or any combination of these attributes can result in an effective inhibition of plant infection, inhibition of plant disease, and/or reduction in severity of disease symptoms.

Example 1

Targets for Multivirus Resistance

Sequences of targeted viruses were assembled from GenBank. FIG. 1 schematically shows the genome organization of representative targeted viruses. For targeted *begomoviruses*, 58 isolates of Tomato yellow leaf curl virus (TYLCV), 30 isolates of Tomato leaf curl New Delhi virus (ToLCNDV), 5 isolates of Tomato severe leaf curl virus (ToSLCV), 5 isolates of Pepper golden mosaic virus (PepGMV), and 2 isolates of Pepper huasteco yellow vein virus (PHYVV) were analyzed. For targeted *tospoviruses*, Tomato spotted wilt virus (TSWV), Groundnut bud necrosis virus (GBNV) and Capsicum chlorosis virus (CaCV), 6 L segments (TSWV: 4; GBNV: 1; CaCV: 1), 23 M segments (TSWV: 20; GBNV: 2; CaCV: 1), and 45 S segments (TSWV: 41; GBNV: 2; CaCV: 2) were analyzed. For isolates of the targeted *potexvirus*, 13 isolates of Pepino mosaic virus (PepMV) were analyzed (e.g. López et al., 2005; Cotillon et al., 2002). A bioinformatics approach was utilized to identify approximately 20-24 nucleotide sequences to be used as artificial miRNAs to suppress as many of the targeted viruses as possible.

The following Table (Table 1) lists sequences analyzed for possible use in designing transgene constructs for generating engineered miRNAs, as well as for identifying sequences for use in dsRNA-mediated viral resistance approaches:

TABLE 1

Exemplary sequences used for bioinformatics analysis (SEQ ID NOs: 169-362)

| Virus type | Virus name | GenBank Accession |
|---|---|---|
| Begomovirus | Tomato yellow leaf curl virus (TYLCV) | AF024715, X15656, X76319, AB014346, AB014347, AB110217, AB110218, AB116629, AB116630, AB116631, AB116632, AB116633, AB116634, AB116635, AB116636, AF071228, AF105975, AF271234, AJ132711, AJ223505, AJ489258, AJ519441, AJ812277, AJ865337, AM282874, AM409201, AM698117, AM698118, AM698119, AY044138, AY134494, AY227892, AY502934, AY530931, AY594174, AY594175. DQ144621, DQ358913, DQ631892, DQ644565, EF051116, EF054893, EF054894, EF060196, EF101929, EF107520, EF110890, EF158044, EF185318, EF210554, EF210555, EF433426, EF523478, EF539831, EU031444, EU143745 |
| Begomovirus | Tomato leaf curl New Delhi virus (ToLCNDV) | NC_004611, U15015, U15016, Y16421, AB330079, AB368447, AB368448, AF102276, AF448058, AF448059, AJ620187, AJ875157, AM286433, AM286434, AM292302, AM850115, AY286316, AY428769, AY939926, DQ116880, DQ116883, DQ116885, DQ169056, EF035482, EF043230, EF043231, EF063145, EF068246, EF450316, EF620534, EU309045 |
| Begomovirus | Tomato severe leaf curl virus (ToSLCV) | AF130415, AJ508784, AJ508785, DQ347946, DQ347947 |
| Begomoivirus | Pepper Huasteco yellow vein virus (PHYVV) | NC_001359, X70418, AY044162 |
| Begomovirus | Pepper golden mosaic virus (PepGMV) | NC_004101, U57457, AF149227, AY928512, AY928514, AY928516 |
| Tospovirus | Tomato spotted wilt wirus (TSWV) (L segment) | NC_002052, D10066, AB190813, AB198742, AY070218 |
| Tospovirus | Tomato spotted wilt wirus (TSWV) (M segment) | NC_002050, S48091, AB010996, AB190818, AF208497, AF208498, AY744481, AY744482, AY744483, AY744484, AY744485, AY744486, AY744487, AY744488, AY744489, AY744490, AY744491, AY744492, AY744493, AY870389, AY870390 |
| Tospovirus | Tomato spotted wilt wirus (TSWV) (S segment) | NC_002051, D00645, AB088385, AB190819, AF020659, AF020660, AJ418777, AJ418778, AJ418779, AJ418780, AJ418781, AY744468, AY744469, AY744470, AY744471, AY744472, AY744473, AY744474, AY744475, AY744476, AY744477, AY744478, AY744479, AY744480, AY870391, AY870392, DQ376177, DQ376178, DQ376179, DQ376180, DQ376181, DQ376182, DQ376183, DQ376184, DQ376185, DQ398945, DQ431237, |

TABLE 1-continued

Exemplary sequences used for bioinformatics analysis (SEQ ID NOs: 169-362)

| Virus type | Virus name | GenBank Accession |
|---|---|---|
| | | DQ431238, DQ915946, DQ915947, DQ915948 |
| Tospovirus | Groundnut bud necrosis virus (GBNV) (L segment) | NC_003614, AF025538 |
| Tospovirus | Groundnut bud necrosis virus (GBNV) (M segment) | NC_003620, U42555, AY871097 |
| Tospovirus | Groundnut bud necrosis virus (GBNV) (S segment) | NC_003619, U27809, AY871098 |
| Tospovirus | Capsicum chlorosis virus (CaCV) (L segment) | NC_008302, DQ256124 |
| Tospovirus | Capsicum chlorosis virus (CaCV) (M segment) | DQ256125 |
| Tospovirus | Capsicum chlorosis virus (CaCV) (S segment) | DQ355974, DQ256123 |
| Potexvirus | Pepino mosaic virus (PepMV) | EF599605, AY509926, AJ438767, DQ000984, DQ000985, AY509927, EF408821, AM491606, AJ606360, AJ606359, AJ606361, AF484251, AM109896 |

Example 2

Virus Segments for RNAi

Figure 2B:
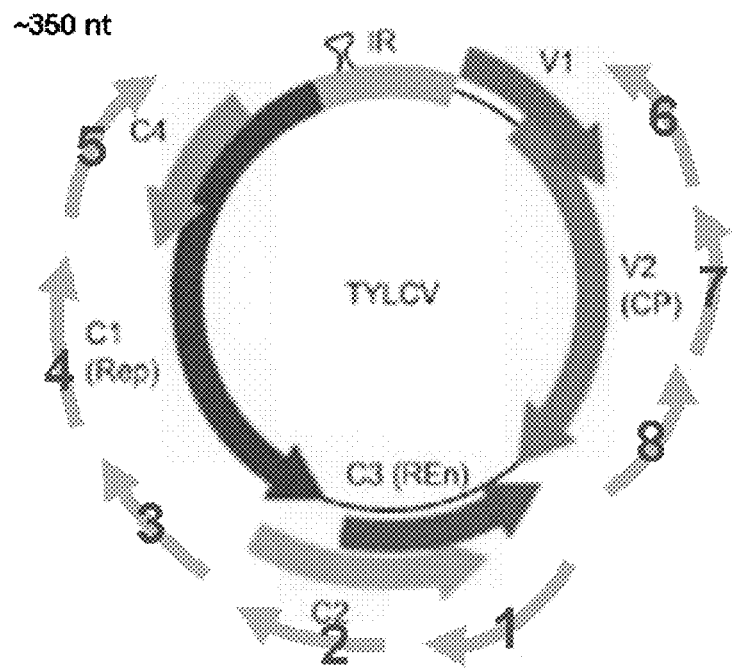
FIG. 2B: Schematic diagram of a typical *begomovirus* DNA-A genome showing location of regions screened for effectiveness for viral control when expressed as inverted repeats. Numbered gray arrows represent portions of genome that were tested.
Figure 2C:
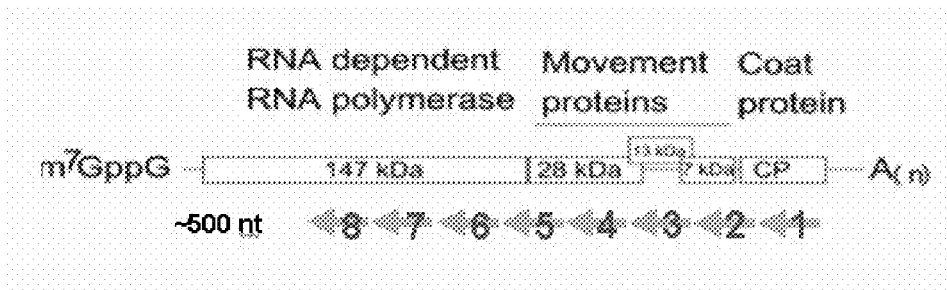
FIG. 2C: Schematic diagram of a typical *potexvirus* (Pepino mosaic virus; PepMV) genome showing location of regions screened for effectiveness for viral control when expressed as inverted repeats. Numbered gray arrows represent portions of genome that were tested.
Figure 2D:
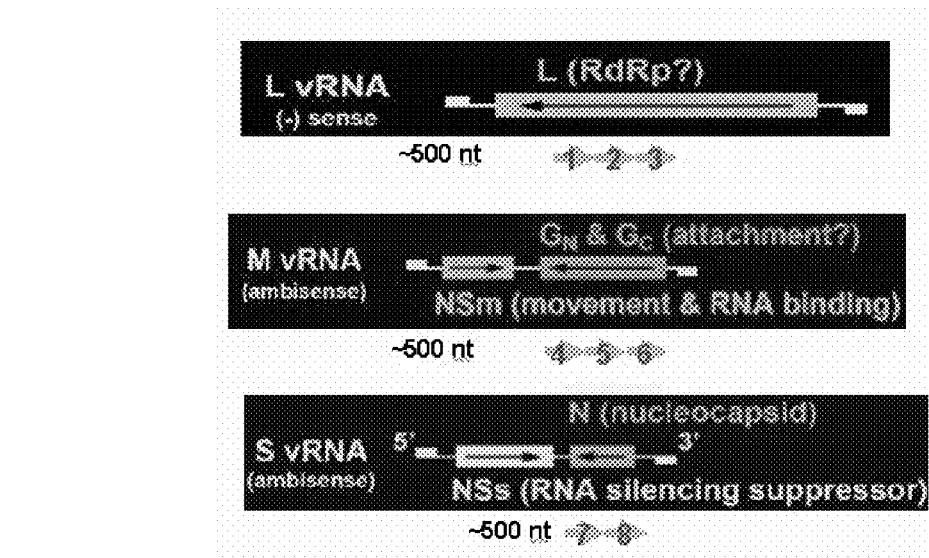
FIG. 2D: Schematic diagram of a *tospovirus* (e.g. Tomato spotted wilt virus (TSWV) genome showing location of regions screened for effectiveness for viral control when expressed as inverted repeats. Numbered gray arrows represent portions of genome that were tested.

Selected viral genomes were divided to ~350-500 bp fragments, partially overlapping by about 50 bp (e.g. FIG. 2A-2D). Efficacy data was collected for the ability of single sequences to control particular virus species when expressed individually in transformed plants. In initial studies, segments corresponding to approximately 2.3 kB out of the 2.7 kB *geminivirus* DNA-A genome were screened (FIG. 2B; segments 1-8). Likewise, as shown in FIG. 2C, segments 1-8 representing approximately 4 kB out of the 6.5 kB PepMV (*potexvirus*) genome were tested. FIG. 2D shows the portions of the tripartite tospovirus genome that were tested for efficacy: approximately 1.5 kB out of the 8.9 kB L vRNA (i.e. virus RNA) (segments 1-3); approximately 1.5 kB of the 5.4 kB M vRNA (segments 4-6); and approximately 1 kB of the 2.9 kB S vRNA (segments 7-8).

Figure 3:
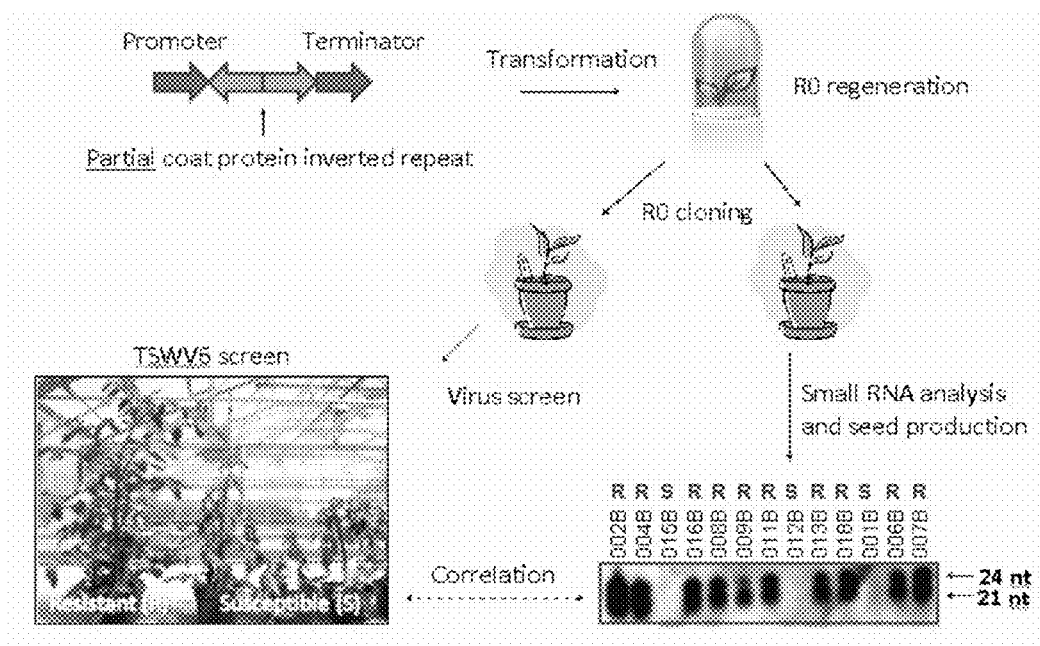
FIG. 3: Virus resistance correlating with siRNA production in transformed tomato plants.

In one representative study, a nucleic acid segment corresponding to a part of the TSWV coat protein (nucleocapsid) was tested for efficacy when expressed as an inverted repeat (FIG. 3). Virus resistance was found to correlate with siRNA production in tomato plants. Also in the TYLCV resistance screen, $R_1$ plants were first examined for the presence of the transgene and then infected with the TYLCV infectious clone. As a control, a non-transformed (wild-type) tomato line was included; these wild-type plants typically have less than 5% "resistance", i.e. less than 5% of plants escape infection by inoculation in this assay. In contrast, among CP4 positive plants (containing the selectable marker gene specifying resistance to glyphosate, which is linked to the expression cassette with viral sequence), 56% of $R_1$ plants comprising an introduced nucleic acid segment targeting the replication protein (3 constructs), 27% comprising an introduced nucleic acid segment targeting the coat protein (3 constructs), and 38% comprising an introduced nucleic acid segment targeting the rest of the coding regions (2 construct) showed resistance to TYLCV.

Additional studies scanning these and additional portions of the tospovirus genome were then undertaken, in order to identify and define portions of the viral genome which can mediate dsRNA-related virus resistance to representative viruses. These sequences were tested as inverted repeat segments in double stranded (dsRNA)-generating constructs, wherein tested constructs comprised a promoter operably linked to a given sequence in an antisense orientation (e.g. SEQ ID NOs:379-442 as described below), followed by a loop sequence, and then the given sequence in a sense orientation, and a transcriptional terminator. After transcription and base pairing of the inverted repeat sequences, the double stranded RNA regions are cleaved by a Dicer or Dicer-like RNAse to generate the specific antiviral siRNAs which target and interfere with viral gene expression.

Capsicum chlorosis virus (CaCV), Groundnut bud necrosis virus (GBNV), and Tomato spotted wilt virus (TSWV), among other *tospoviruses*. Virus resistance tests of transgenic $R_1$ plants demonstrated that all regions of the *tospovirus* genome are equally as effective as the target of dsRNA. Thus, significant virus resistance was seen following expression of transcripts which disrupt expression of *tospovirus* coat protein (CP), as well as the glycoprotein-encoding virus genome segments GP1, GP2, GP3, and RNA-dependent-RNA polymerase (RdRP) protein segments. FIG. 11A-B describes resistance results seen from transgenic plants. With each bar representing an individual transgenic event and target region, for instance 50-80% of $R_1$ plants expressing a dsRNA targeting the CP region were resistant to CaCV, while ~25-90% of $R_1$ plants expressing a dsRNA targeting a virus glycoprotein showed virus resistance, and about 25-80% of $R_1$ plants expressing a dsRNA targeting a virus RdRP showed resistance (e.g. FIG. 11B). dsRNA-mediated resistance to TSWV was particularly effective, with 100% of $R_1$ plants displaying virus resistance from all tested events with constructs targeting the coat protein (FIG. 11A). Representative TSWV, CaCV, and GBNV sequences selected for use in generation of dsRNAs targeting *tospovirus* gene expression are listed in SEQ ID NOs:419-436 (in antisense orientation as listed).

Figure 12:
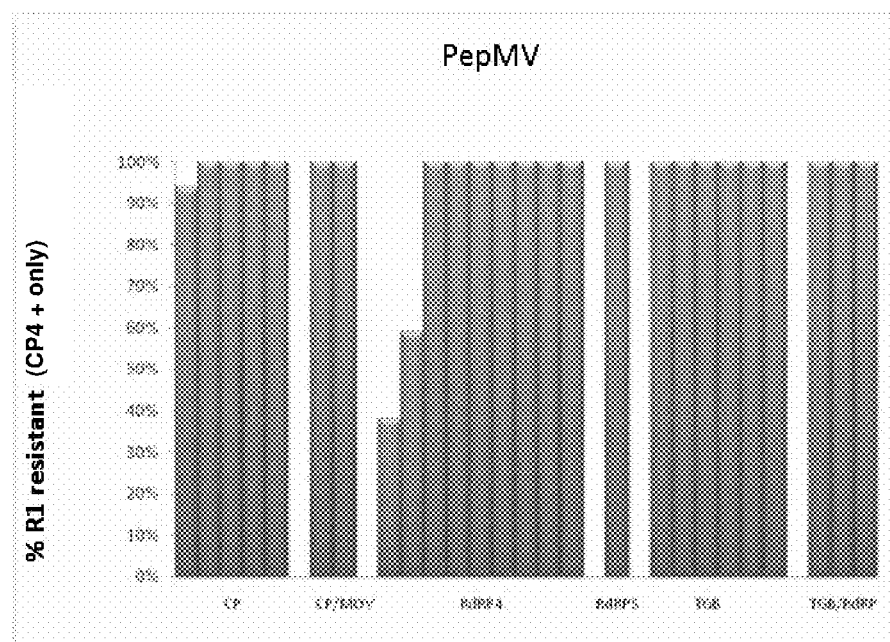
FIG. 12: Regions of the PepMV genome tested for effectiveness in generating dsRNA-mediated resistance against this *potexvirus* (CP: coat protein; Mov: movement protein; RdRP, or RdR: RNA-dependent RNA polymerase; TGB: Triple gene block protein).

Additional studies demonstrated that all regions of the PepMV genome are equally effective in generating dsRNA-mediated resistance against this *potexvirus*. FIG. 12 shows that in most cases, 95-100% of all transgenic $R_1$ plants comprising virus-encoded segments targeting CP (coat protein), CP/MOV (Coat Protein and Movement Protein sequences), RdRP, TGB (Triple Gene Block motif protein implicated in viral cell-to-cell and long distance movement in a host plant), or TGB/RdRP were resistant to PepMV. Representative PepMV sequences selected for use in generation of dsRNAs targeting *potexvirus* gene expression are listed in SEQ ID NOs:437-442, in antisense orientation as listed.

Figure 13A:
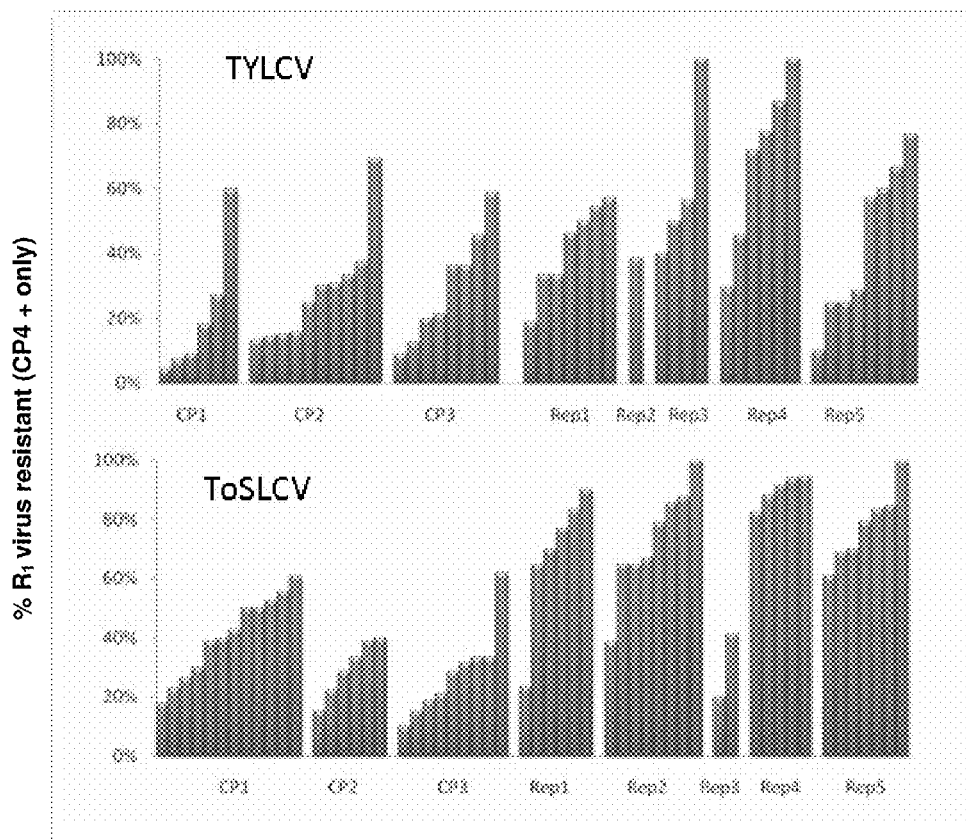
FIG. 13A, 13B: Regions of *geminivirus* genome assayed for effectiveness in generating dsRNA-mediated resistance against this virus group. (CP: coat protein; Rep: replication protein). Other transgenic plants contain a glyphosate resistance gene. "0%-100%" denotes the percentage of $R_1$ plants that are selectable-marker positive and virus resistant.
Figure 13B:
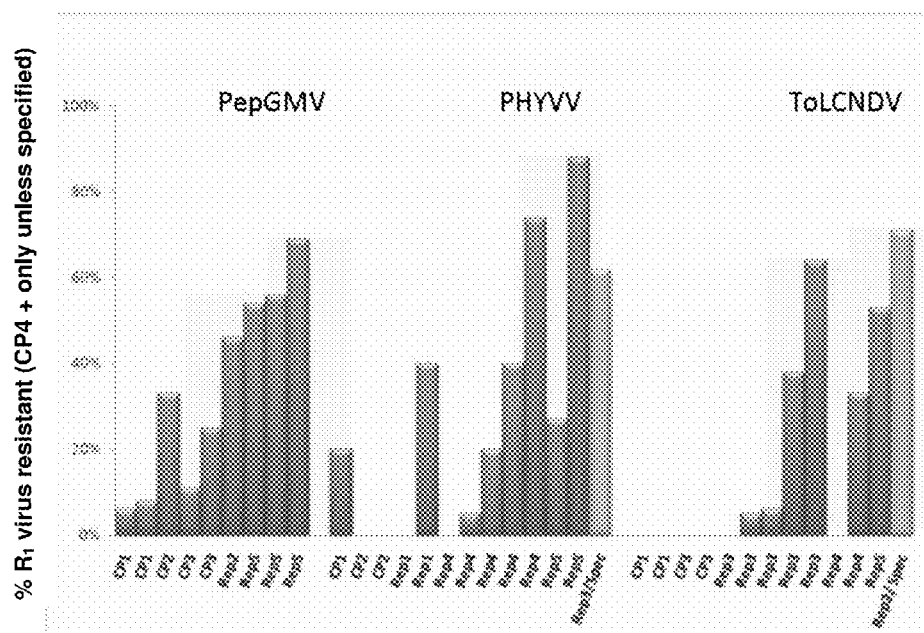

Likewise, regions of the *begomovirus* (*geminivirus*) genome were tested for their ability to generate dsRNA-mediated resistance against this virus group. TYLCV, ToSLCV, PepGMV, PHYVV, and ToLCNDV were tested in bioassays as representative *begomoviruses*. FIGS. 13A-B shows that up to about 70% of transgenic R₁ plants displayed resistance to a given virus when CP was the dsRNA target, while up to about 100% of transgenic R₁ plants displayed resistance when a nucleic acid segment encoding viral replication protein was the dsRNA target. Representative *tospovirus* sequences selected for use in generation of dsRNAs targeting *begomovirus* gene expression are listed in SEQ ID NOs:379-418, in antisense orientation as listed.

Together, numerous effective dsRNA targets for viruses in these three genera (i.e. *tospovirus, potexvirus, begomovirus*) were identified.

Figure 14:
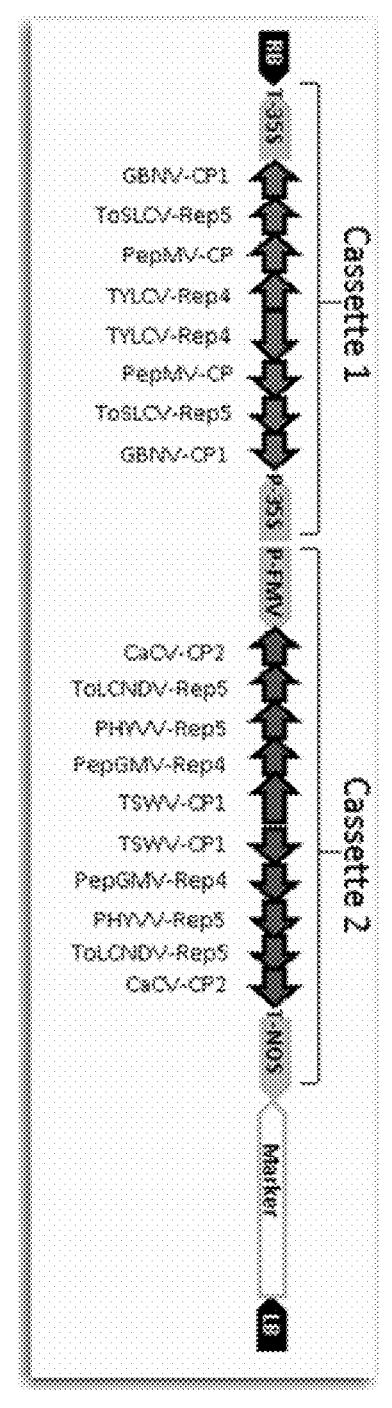

Based on these RNAi results, sequences targeting efficacious target regions were selected for each virus and fused into two transgenic cassettes on a nucleic acid construct, to target multiple viruses in multiple virus families. An example of this approach is shown in FIG. 14. For *begomoviruses*, a Rep region was used, while for *tospovirus* and *potexvirus*, CP regions were selected since the CP region is relatively more conserved among different strains of the same viruses. Some of the sequences utilized in the cassettes were further modified, in view of expected G::U base pairings, to allow for broadening of protection to related viral strains. Representative sequences selected for use in generation of dsRNAs targeting virus gene expression in the cassettes are listed in SEQ ID NOs:443-446 for "cassette 1" of FIG. 14, and in SEQ ID NOs:447-451 for "cassette 2" of FIG. 14, each in antisense orientation as listed in the sequence listing. Thus, for instance, the nucleic acid segment targeting GBNV-CP1 which is found in cassette 1 (SEQ ID NO:443) is similar to the segment targeting GBNV-CP1 as found in SEQ ID NO:429, but may have modification as noted above, and likewise for the other nucleic acid segments used in the cassettes, relative to the target segments as initially tested for relative efficacy.

Example 3

Artificial dsRNA Fusion Constructs for Multivirus Resistance

Figure 4:
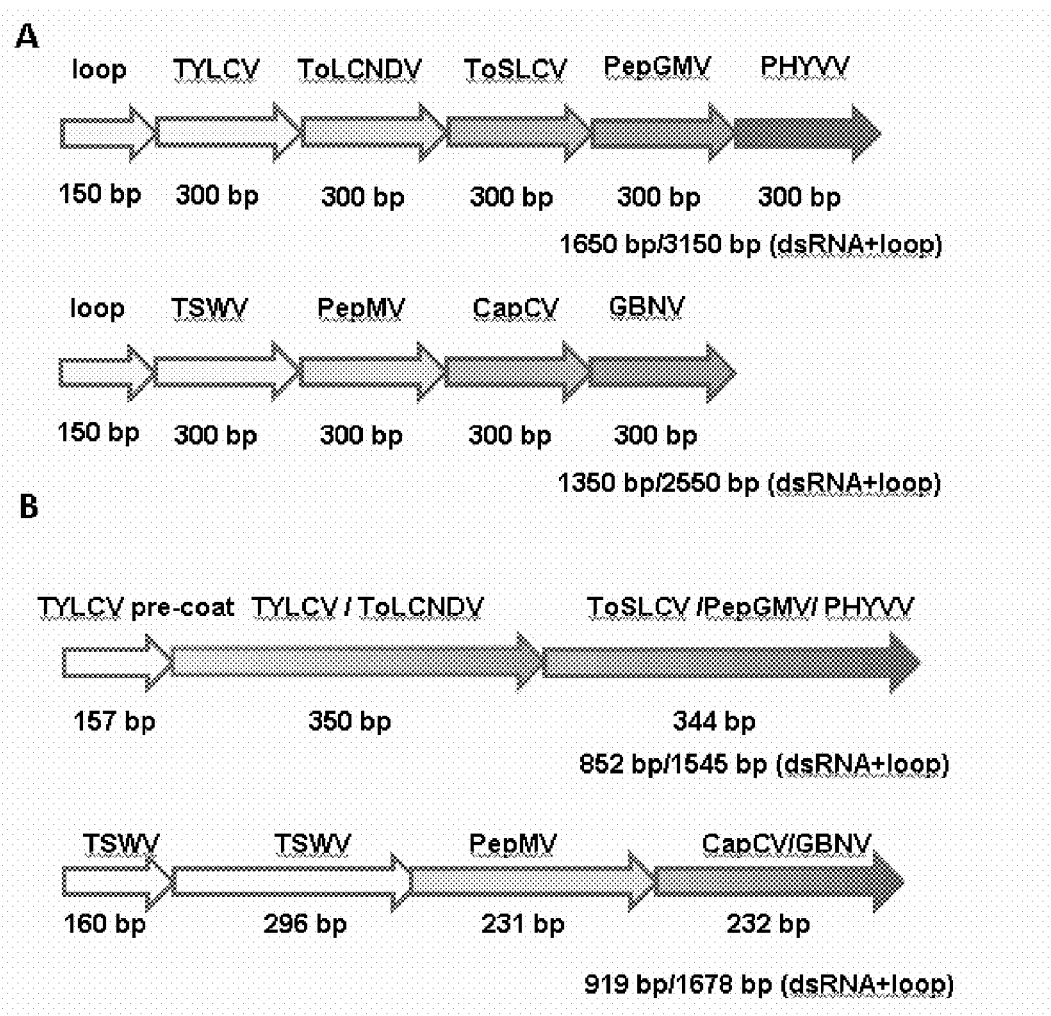
FIGS. 4A, 4B Exemplary artificial dsRNA fusion constructs for conferring multiple virus resistance ("MVR").

Nucleotide segments for dsRNA expression, from two or three of the different virus groups (*geminivirus, tospovirus, potexvirus*), were also combined in a single expression cassette and plants were generated from transformed cells and analyzed for resistance to more than one virus. This was accomplished by fusing viral genomic fragments that tested effective for generating siRNAs conferring virus resistance, for instance as shown in Example 2. Analogously to Example 2, these sequences were tested as inverted repeat segments in double stranded (dsRNA)-generating constructs, wherein tested constructs comprised a promoter operably linked to a given sequence in an antisense orientation (e.g. SEQ ID NOs: 452-454 as described below), followed by a loop sequence, and then the given sequence in a sense orientation, and a transcriptional terminator. After transcription and base pairing of the inverted repeat sequences, the double stranded RNA regions are cleaved by a Dicer or Dicer-like RNAse to generate the specific antiviral siRNAs which target and interfere with viral gene expression. In this approach, specific dsRNA segments for each of the targeted virus were used for multiple virus resistance (FIG. 4A).

Alternatively, conserved regions of the various viral genomes may provide a broader spectrum of resistance against different variants within the species or closely related species. Additionally, inverted repeats comprising sequences that are highly similar to, but less than 100% identical to, targeted segments of viral genomes may be designed and tested for efficacy. This approach, i.e. partially similar or "imperfect" inverted repeats, may broaden RNA-mediated protection to related virus strains and species. For instance, since G-U basepairing at the RNA level has a comparable degree of thermodynamic stability as some typical Watson-Crick baseparing (e.g. A-U), some imperfect repeats may nonetheless activate RISC and guide cleavage of both perfect and imperfect viral targets.

In this instance, such partially similar inverted repeats may also comprise one or more sub-sequences of at least 21 nucleotides in length that display near 100% identity to one or more viral target sequences, in order to stimulate RNAi-mediated virus resistance. Thus for instance, the overall identity of an imperfect repeat segment to one or more viral target(s) may be as low as 75%, but with 2-4 or more sub-sequences of 21-24 nucleotides that display 100% identity to a viral target sequence. Additionally, the presence of such "imperfect" dsRNA may help to increase accumulation of dsRNA in plants and prevent the triggering of transcriptional gene silencing. Thus, nucleotide segments from more than one strain of a virus, or from more than one virus, may be utilized in design and preparation of a fusion construct for dsRNA expression.

Such sequences may be identified by aligning, for instance, *geminivirus* or *tospovirus* sequences from multiple strains and/or species. Table 2 shows percent similarities between *geminivirus* targets at the whole genome level. Table 3 shows percent similarities between tospovirus targets at the whole genome level.

TABLE 2

Percent similarities between geminivirus targets (whole genome).

| | TYLCV | ToLCNDV | PHYVV | ToSLCV | PepGMV |
|---|---|---|---|---|---|
| TYLCV | — | 71 | 64 | 63 | 60 |
| ToLCNDV | 71 | — | 62 | 60 | 59 |
| PHYVV | 64 | 62 | — | 67 | 66 |
| ToSLCV | 63 | 60 | 67 | — | 76 |
| PepGMV | 60 | 59 | 66 | 76 | — |

TABLE 3

Percent similarities between tospovirus targets (whole genome).

| Segment | Virus | CapCV | GBNV | TSWV |
|---|---|---|---|---|
| L vRNA 8.8 kb | CapCV_L | — | 44 | 45 |
| | GBNV_L | 44 | — | 58 |
| | TSWV_L | 45 | 58 | — |
| M vRNA 4.8-5.4 kB | CapCV_M | — | 78 | 53 |
| | GBNV_M | 78 | — | 54 |
| | TSWV_M | 53 | 54 | — |
| S vRNA 2.9-3.3 kB | CapCV_S | — | 65 | 42 |
| | GBNV_S | 73 | — | 48 |
| | TSWV_S | 49 | 49 | — |

Figure 15:
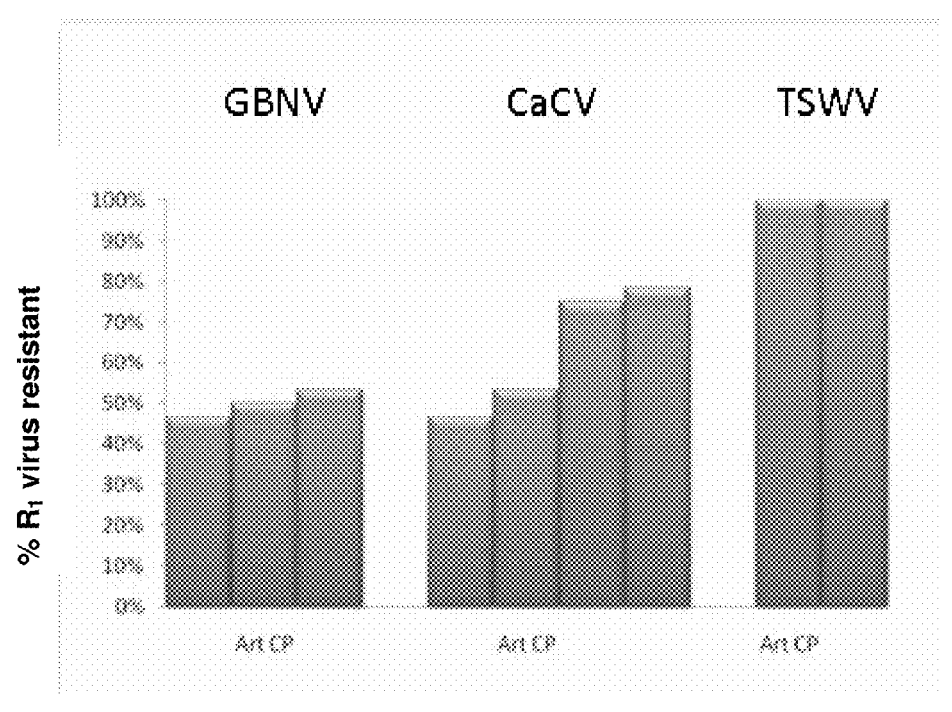

FIG. 4B schematically illustrates exemplary fusion constructs for dsRNA expression. Coding sequences, including sequences lacking significant identity with human and host plant genomes, were selected for generation of inverted repeats. Viral-derived segments may be oriented, for instance, "antisense-loop-sense" for dsRNA expression. This approach can reduce the size of a transgenic dsRNA cassette required for multiple virus resistance. The schematically described artificial fusion constructs of FIG. 4B are listed as SEQ ID NOs: 452-453. SEQ ID NO:452 artificial coat protein construct comprises sequences as follows: bp 1-157: TYLCV precoat protein for the loop; bp 158-507 (i.e. 350 bp segment) targeting TYLCV and ToLCNDV CP; bp 508-851 (i.e. 344 bp segment) targeting ToSLCV, PepGMV, and PHYVV CP expression. SEQ ID NO:453 comprises segments as follows: bp 1-160 targeting TSWV coat protein (CP) for the loop; bp 161-456 (i.e. 296 bp segment) targeting TSWV CP; bp 457-687 (i.e. 231 bp segment) targeting the PepMV CP; bp 688-919 (i.e. 232 bp segment) targeting the CaCV and GBNV CP. Efficacy results for SEQ ID NO:453, the artificial CP sequence against multiple *tospoviruses* and PepMV, are shown in FIG. 15. An additional artificial dsRNA fusion construct targeting Rep proteins of five *geminiviruses* (TYLCV, ToLCNDV, ToSLCV, PepGMV, and PHYVV) is given as SEQ ID NO:454. In this sequence, bp 1-150 target TYLCV Rep protein for the loop; bp 151-500 (i.e. 350 bp segment) target TYLCV and ToLCNDV Rep protein; bp 501-860 (i.e. 360 bp segment) target ToSLCV, PepGMV, and PHYVV Rep protein.

Example 4

Engineered miRNA Approach

Selection of Suitable Sequences

The bioinformatics approach described in Example 1 was used to identify several suitable sequences, approximately 21 nt in length, that target *geminivirus* sequences thought to be useful for miRNA-mediated suppression of *geminivirus* replication and/or symptom expression (Table 4; FIG. 5).

TABLE 4

Suitable 21 nt sequences against targeted Geminiviruses.

| SEQ ID NO: | Name | miRNA Sequence (5' → 3') | Target |
|---|---|---|---|
| 1 | Gemini 1 | TGTCATCAATGACGTTGTACT | Rep |
| 7 | Gemini 2 | TGGACTTTACATGGGCCTTCA | Coat Protein |
| 13 | Gemini 3 | TACATGCCATATACAATAGCA | Coat Protein |
| 19 | Gemini 4 | TCATAGAAGTAGATCCGGATT | Coat Protein |
| 25 | Gemini 5 | TTCCCCTGTGCGTGAATCCGT | C2/C3 |
| 31 | Gemini 6 | TTCCGCCTTTAATTTGGATTG | Rep |
| 37 | Gemini 7 | TTACATGGGCCTTCACAGCCT | Coat Protein |

The bioinformatics approach described in Example 1 was used to identify several suitable sequences, approximately 21 nt in length, that target *Tospovirus* sequences thought to be useful for miRNA-mediated suppression of *Tospovirus* replication and/or symptom expression (Table 5; FIG. 6).

TABLE 5

Suitable 21 nt sequences for each genomic segment against three targeted Tospoviruses.

| SEQ ID NO: | Name | miRNA Sequence (5' → 3') | Target |
|---|---|---|---|
| 43 | Tospo L1-1 | TTTAGGCATCATATAGATAGCT | RdRP |
| 47 | Tospo L1-2 | TGATTTAGGCATCATATAGAT | RdRP |
| 51 | Tospo M1 | TATCTATATTTTCCATCTACC | GP |

TABLE 5-continued

Suitable 21 nt sequences for each genomic segment against three targeted Tospoviruses.

| SEQ ID NO: | Name | miRNA Sequence (5' → 3') | Target |
|---|---|---|---|
| 55 | Tospo M2 | TTAGTTTGCAGGCTTCAATTA | NSm |
| 59 | Tospo M3 | TTGCATGCTTCAATGAGAGCT | NSm |
| 63 | Tospo S2 | TTGACGTTAGACATGGTGTTT | N |
| 67 | Tospo S3 | TAGAAAGTTTTGAAGTTGAAT | N |

The bioinformatics approach described in Example 1 was used to identify several suitable sequences, approximately 21 nt in length, that target *potexvirus* sequences thought to be useful for miRNA-mediated suppression of *Tospovirus* replication and/or symptom expression (Table 6; FIG. 7A-7B).

TABLE 6

Suitable ~21 nt sequences against targeted potexvirus.

| SEQ ID NO: | Name | miRNA Sequence (5' → 3') | Target |
|---|---|---|---|
| 71 | PepMV1 | TCTTCATTGTAGTTAATGGAG | RdPR |
| 85 | PepMV2 | TTGGAAGAGGAAAAGGTGGTT | RdPR |
| 99 | PepMV3 | TCAATCATGCACCTCCAGTCG | RdPR |
| 113 | PepMV4 | TAAGTAGCAAGGCCTAGGTGA | TGBp1 |
| 127 | PepMV5 | TTTGGAAGTAAATGCAGGCTG | TGBp2 |
| 141 | PepMV6 | TAACCCGTTCCAAGGGGAGAAG | TGBp3 |

Example 5

Incorporation of miRNA-Generating Sequences in a MIR Gene Backbone

The miRNA-generating sequences of Tables 4-6 were incorporated into transgene constructs by gene synthesis. For instance, the wildtype MIR gene backbone "MON1" (see U.S. Publication 2007/0300329) from soybean with the wildtype 21nt miRNA-generating sequence (SEQ ID NO:155 of the present application) was altered to replace the wildtype miRNA-generating sequence with the Gemini1 target (SEQ ID NO:1), resulting in the Gemini1/MON1 construct (SEQ ID NO:156). Thus, a MIR backbone (e.g. the MON1 backbone of SEQ ID NO:155) can be altered by replacing the wildtype 21nt miRNA-generating sequence with any of the miRNA sequences of Tables 4-6.

Similarly, MON5 from soybean (SEQ ID NO:157), MON13 from rice (SEQ ID NO:159), MON18 from maize (SEQ ID NO:161), miR159a from maize (SEQ ID NO:163), or miR167g (SEQ ID NO:165), were used as backbone sequences with miRNA-generating sequences of Tables 4-6. Thus, the following sequences were created (Table 7):

TABLE 7

Exemplary sequences incorporated into MIR gene backbone.

| miRNA-generating sequence (SEQ ID NO) | MIR backbone (SEQ ID NO) | Incorporated construct (SEQ ID NO) |
|---|---|---|
| Gemini 1 (SEQ ID NO: 1) | MON1 (SEQ ID NO: 155) | Gemini1/MON1 (SEQ ID NO: 156) |
| Gemini 4 (SEQ ID NO: 19) | MON5 (SEQ ID NO: 157) | Gemini 4/MON5 (SEQ ID NO: 158) |
| Gemini 7 (SEQ ID NO: 37) | MON13 (SEQ ID NO: 159) | Gemini 7/MON13 (SEQ ID NO: 160) |
| PepMV5 (SEQ ID NO: 127) | MON18 (SEQ ID NO: 161) | PepMV5/MON18 (SEQ ID NO: 162) |
| Gemini 6 (SEQ ID NO: 31) | miR159a (SEQ ID NO: 163) | Gemini 6/miR159a (SEQ ID NO: 164) |
| PepMV6 (SEQ ID NO: 141) | miR167g (SEQ ID NO: 165) | PepMV6/miR167g (SEQ ID NO: 166) |
| Gemini 2 (SEQ ID NO: 7) | MON13 (SEQ ID NO: 159) | Gemini 2/MON13 (SEQ ID NO: 367) |
| Gemini 3 (SEQ ID NO: 13) | MON1 (SEQ ID NO: 155) | Gemini3/MON1 (SEQ ID NO: 368) |
| Gemini 5 (SEQ ID NO: 25) | miR159a (SEQ ID NO: 163) | Gemini 5/MiR159a (SEQ ID NO: 369) |
| PepMV1 (SEQ ID NO: 71) | miR159a (SEQ ID NO: 163) | PepMV1/miR159a (SEQ ID NO: 363) |
| PepMV2 (SEQ ID NO: 85) | MON5 (SEQ ID NO: 157) | PepMV2/MON5 (SEQ ID NO: 364) |
| PepMV3 (SEQ ID NO: 99) | MON13 (SEQ ID NO: 159) | PepMV3/MON13 (SEQ ID NO: 365) |
| PepMV4 (SEQ ID NO: 113) | MON1 (SEQ ID NO: 155) | PepMV4/MON1 (SEQ ID NO: 366) |
| TospoL1-1 (SEQ ID NO: 43) | miR167g (SEQ ID NO: 165) | TospoL1-1/miR167g SEQ ID NO: 370) |
| TospoL1-2 (SEQ ID NO: 47) | MON1 (SEQ ID NO: 155) | TospoL1-2/MON1 (SEQ ID NO: 371) |
| TospoM2 (SEQ ID NO: 55) | MON1 (SEQ ID NO: 155) | TospoM2/MON1 (SEQ ID NO: 372) |
| TospoM3 (SEQ ID NO: 59) | MON13 (SEQ ID NO: 159) | TospoM3/MON13 (SEQ ID NO: 373) |
| TospoS2 (SEQ ID NO: 63) | MON5 (SEQ ID NO: 157) | TospoS2/MON5 (SEQ ID NO: 374) |
| TospoS3 (SEQ ID NO: 67) | MON13 (SEQ ID NO: 159) | TospoS3/MON13 (SEQ ID NO: 375) |

Other selected miRNA-generating sequences, for instance from among any of SEQ ID NOs:1-154, or from within SEQ ID NOs:169-362 or portions thereof, may be utilized with MIR backbone sequences, for instance MON1 from soybean, MON5 from soybean, MON13 from rice, MON18 from maize, miR159a from maize, or mi167g from maize (SEQ ID NOs:155, 157, 159, 161, 163, or 165) to create additional efficacious miRNA-generating constructs. Additionally, the MIR backbone sequences may be modified for instance by replacing the portion of the sequence of the plant-derived backbone sequence which specifies an miRNA with a selected virus-derived or artificial (e.g. consensus) sequence, and/or shortened, e.g. a deletion made at the 3' and/or 5' end, for instance as reflected in the miRNA-generating sequences and MIR backbone portions of SEQ ID NOs:158, 160, 162, 164, 166, 363, 364, 365, 367, 369, 370, 373, 374, and 375, described below.

Figure 8:
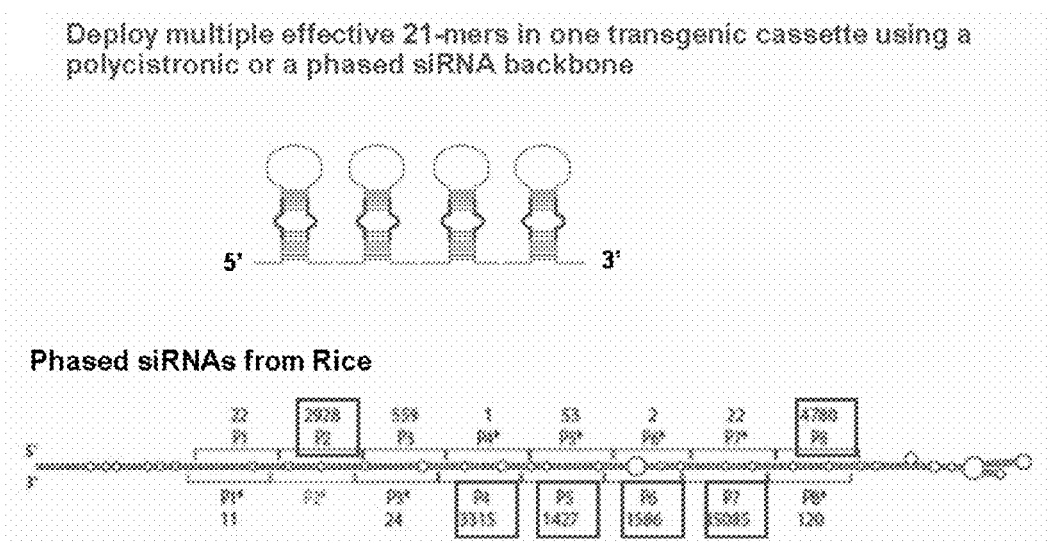
FIG. 8: Schematic of exemplary construct for deploying multiple engineered miRNAs in one transgenic cassette, such as with phased siRNAs.

21-mers identified from within SEQ ID NOs:169-362, for instance among or within SEQ ID NOs:1-154, are tested individually, or two or more at a time while present in one expression cassette, for efficacy in transgenic tomato plants against appropriate viruses such as TYLCV and TSWV. Multiple effective 21-mers are expressed in one transgenic cassette using a polycistronic or a phased siRNA backbone (e.g. FIG. 8). Results of virus resistance assays from such testing of 21-mers are given in Example 7.

Once the efficacious antiviral miRNAs are identified, multiple miRNAs are deployed by expressing as a single transgenic trait, to achieve multiple virus resistance in transgenic plants. This is accomplished by fusing engineered MIR gene(s) described above together (e.g. to create SEQ ID NOs: 156, 158, 160, 162, 164, 166, 363-375), or using a ta-siRNA or a phased siRNA gene structure that can deliver multiple antiviral ~21nt sequences (e.g. FIG. 8). The later approaches are accomplished via a new round of gene synthesis to replace wild-type siRNAs with the efficacious antiviral 21nt sequences in the ta-siRNA or phased siRNA backbone.

Example 6

Supplementing RNA-Based Resistance

The RNA-mediated resistance approach utilizing dsRNA or miRNA can be supplemented by placing antiviral sequences, e.g. ones that encode a protein, into the loop of a dsRNA-encoding sequence, or by inserting a sequence that encodes an efficacious dsRNA or miRNA into an intron of a polypeptide expression cassette (intronic dsRNA/miRNA; Frizzi et al., 2008) (e.g. FIG. 9). For example, viral protein(s) such as coat protein and/or replicase may be expressed in a transgenic plant that also expresses an efficacious dsRNA, miRNA, or siRNA, without use of an additional transgene cassette, by inserting protein coding sequence into the loop of a dsRNA. A sequence that encodes a peptide aptamer that interferes with *geminivirus* replication may also be employed (e.g. Lopez-Ochoa et al., 2006).

Thus, artificial sequences may be expressed along with the dsRNA, miRNA, or siRNA in order to augment the virus resistant phenotype. For instance, an artificial nucleotide loop engineered from the *tospovirus* genome may be used. The *tospovirus* (ssRNA) genome comprises a "panhandle" structure due to the presence of conserved terminal repeats of 8-11 nt at both ends of each genome component. These terminal repeats from each component of the genome (SEQ ID NOs: 167-168), for instance from GBNV (Groundnut bud necrosis virus) or CaCV (Capsicum chlorosis virus), may be fused and used as part of a loop-forming sequence in a plant transformation construct. Such an artificial sequence may comprise, for instance, SEQ ID NOs:376-378, or SEQ ID NO:455, and can serve as an artificial substrate competing for reverse transcriptase, may interfere with proper circularization of replicating viral genome components, may themselves generate nucleotide segments efficacious via RNAi, or one or more of the above, thus interfering with virion assembly.

Figure 16:
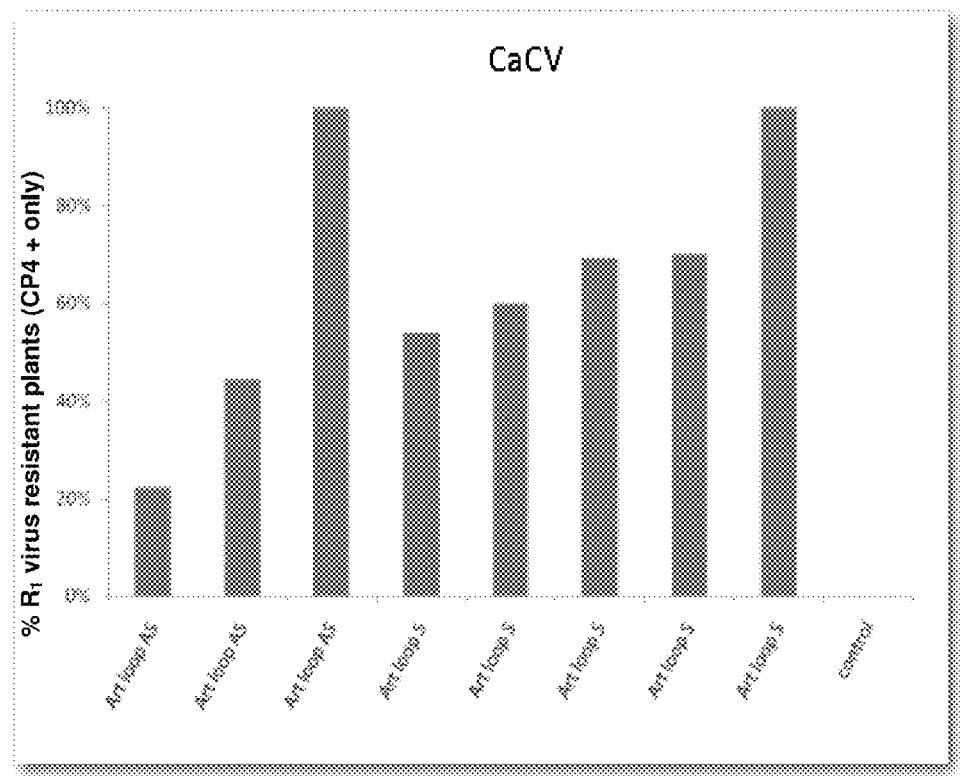
FIG. 16: Depicts resistance observed against inoculated CaCV in inoculated CP4 positive $R_1$ plants transformed with a construct comprising *tospovirus* terminal repeat sequences (SEQ ID NOs:167, 168, 376, 377, 378, as found in SEQ ID NO:455).

FIG. 16 demonstrates that inclusion of *tospovirus* terminal sequences in a construct for generating dsRNA results in measurable resistance to a virus such as CaCV. In the tested construct, SEQ ID NOs:376-378, themselves comprising SEQ ID NOs:168, were fused to create SEQ ID NO:455 (i.e. bp 1-247 of SEQ ID NO:455 comprise SEQ ID NO:376; bp 248-303 comprise SEQ ID NO:377, and bp 304-369 comprise SEQ ID NO:378). The construct was tested in both sense and antisense orientations, and the level of virus resistance was compared to that demonstrated by a control tomato plant, non-transgenic but otherwise isogenic.

Sequences encoding, for instance, coat protein or replicase, as well as artificial sequences described above, may be embedded within an intron sequence as well. Thus, multiple modes of action may be deployed by being engineered into a single expression cassette (e.g. FIG. 9), or more than one expression cassette.

Example 7

Results of Exemplary Virus Resistance Assays Using Engineered miRNAs

Engineered miRNA-producing constructs as listed in Table 7 were tested for efficacy. Bioassay results for *geminivirus* and *potexvirus* assays are shown in Tables 8-9. Virus resistance was observed due to miRNA expression, and correlating to expression and proper processing of a given transgene transcript. For instance, for SEQ ID NO:166, proper processing of PepMV6/mir167g was not observed, nor was virus resistance seen for this construct, thus correlating miRNA production with virus resistance in transgenic $R_1$ plants. Regarding tospovirus experiments, expression and proper processing of transcripts from SEQ ID NOs:370, 371, 373, and 375 was observed, targeting, respectively, the RdRP, RdRP, NsM, and N genes. CP4-positive $R_1$ plants displayed reduced symptoms when infected with TSWV. For SEQ ID NOs:372 and 374, targeting, respectively, the NsM and N genes, proper processing of miRNA was not observed, and no reduction in symptoms was noted.

The synthetic miRNAs were most effective against PepMV, and gave delayed or reduced virus infection symptoms against *geminiviruses* and *tospovirus*. The constructs can be combined in stacked miRNA cassettes in order to synergistically inhibit the target viruses. Since multiple miRNAs can be expressed from a single expression cassette, constructs expressing, for instance, 8 or 10 antiviral miRNAs can be created (as shown in FIG. 10A-10B). As an additional approach, antiviral miRNA expression cassettes can be inserted as the "loop" sequence (e.g. FIG. 9) of a dsRNA expression cassette, to combine the dsRNA and miRNA mechanisms for viral control (see FIG. 10C).

TABLE 8

Results of geminivirus resistance assays utilizing engineered sequences incorporated into MIR gene backbones.

| Incorporated construct (SEQ ID NO) | miRNA | Expression[a] | % Virus Resistance[b] | | | | Target Region |
|---|---|---|---|---|---|---|---|
| | | | TYLCV | ToLCNDV | PepGMV | PHYVV | |
| SEQ ID NO: 156 | Gemini1/MON1 | yes | 16 ± 16% | 31 ± 17 | 37 ± 13 | 29 ± 16 | Rep |
| SEQ ID NO: 367 | Gemini 2/MON13 | yes | 34 ± 27 | 27 ± 14 | 29 ± 4 | 32 ± 16 | CP |
| SEQ ID NO: 368 | Gemini3/MON1 | yes | 13 ± 8 | 23 ± 7 | 34 ± 11 | 14 ± 19 | CP |
| SEQ ID NO: 158 | Gemini4/MON5 | no | — | — | — | — | CP |
| SEQ ID NO: 369 | Gemini5/miR159a | yes | 14 ± 19 | 30 ± 20 | 51 ± 16 | 28 ± 37 | C2/C3 |
| SEQ ID NO: 164 | Gemini6/miR159a | yes | 20 ± 13 | 23 ± 12 | 36 ± 10 | 23 ± 19 | Rep |
| SEQ ID NO: 160 | Gemini 7-1/MON13 | yes | 7 | 28 | 40 | 11 | CP |

[a] proper processing of the miRNA detected in transgenic plants

[b] average percentage ± s.d. of R1 CP4-positive segregants for resistance to tomato yellow leaf curl virus (TYLCV), Tomato leaf curl New Delhi virus (ToLCNDV), Pepper golden mosaic virus (PePGMV), or Pepper Huasteco yellow vein virus (PHYVV)

TABLE 9

Results of Pepino mosaic virus (PepMV) resistance assays utilizing engineered sequences incorporated into MIR gene backbones.

| Incorporated constru

SEQUENCE LISTING (455 sequences)

SEQ ID NO: 1 - DNA, 21 bp, Artificial Sequence
  Description of Artificial Sequence: Synthetic consensus sequence (Gemini1)
tgtcatcaatgacgttgtact

SEQ ID NO: 2 - DNA, 31 bp, Tomato yellow leaf curl virus
gcgtggtacaacgtcattgatgacgtagacc

SEQ ID NO: 3 - DNA, 31 bp, Tomato leaf curl New Delhi virus
gcctggtacaacgtcattgatgacgttgatc

SEQ ID NO: 4 - DNA, 31 bp, Tomato severe leaf curl virus
gcggaatacaacgtcattgatgacatcactc

SEQ ID NO: 5 - DNA, 31 bp, Pepper golden mosaic virus
gtggagtataacgtcattgatgatatcacgc

SEQ ID NO: 6 - DNA, 31 bp, Pepper Huasteco yellow vein virus
gcatggtataacgtcattgatgacatccctc

SEQ ID NO: 7 - DNA, 21 bp, Artificial Sequence
  Description of Artificial Sequence: Synthetic consensus sequence (Gemini2)
tggactttacatgggccttca

SEQ ID NO: 8 - DNA, 31 bp, Tomato yellow leaf curl virus
ggatgtgaaggcccatgtaaagtccagtctt

SEQ ID NO: 9 - DNA, 31 bp, Tomato leaf curl New Delhi virus
ggctgtgaaggcccttgtaaagtgcagtcct

SEQ ID NO: 10 - DNA, 31 bp, Tomato severe leaf curl virus
ggctgtgaaggcccatgtaaggtccagtcct

SEQ ID NO: 11 - DNA, 31 bp, Pepper golden mosaic virus
ggatgtgaagggccatgtaaggtccagtcct

SEQ ID NO: 12 - DNA, 31 bp, Pepper Huasteco yellow vein virus
ggttgtgaaggtccctgtaaggttcaatcgt

SEQ ID NO: 13 - DNA, 21 bp, Artificial Sequence
  Description of Artificial Sequence: Synthetic consensus sequence (Gemini3)
tacatgccatatacaatagca

SEQ ID NO: 14 - DNA, 31 bp, Tomato yellow leaf curl virus
ccttgttattgtatatggcatgtacgcatgc

SEQ ID NO: 15 - DNA, 31 bp, Tomato leaf curl New Delhi virus
cattaatgttgtatatggcctgtactcacgc

SEQ ID NO: 16 - DNA, 31 bp, Tomato severe leaf curl virus
ccctgttattgtatatggcatgtactcatgc

SEQ ID NO: 17 - DNA, 31 bp, Pepper golden mosaic virus
ccctgctattgtatatggcatgtacacatgc

SEQ ID NO: 18 - DNA, 31 bp, Pepper Huasteco yellow vein virus
cgctgttattgtatatggcatgtactcatgc

SEQ ID NO: 19 - DNA, 21 bp, Artificial Sequence
  Description of Artificial Sequence: Synthetic consensus sequence (Gemini4)
tcatagaagtagatccggatt

SEQ ID NO: 20 - DNA, 31 bp, Tomato yellow leaf curl virus
aaaatacgcatctatttctatgattcaatat

SEQ ID NO: 21 - DNA, 31 bp, Tomato leaf curl New Delhi virus
aaaatccggatctacttttatgattcggcca

SEQ ID NO: 22 - DNA, 31 bp, Tomato severe leaf curl virus
aagatccggatctatttttatgattcggtat

SEQ ID NO: 23 - DNA, 31 bp, Pepper golden mosaic virus
aaaattcgaatctatttttatgattcgataa

SEQ ID NO: 24 - DNA, 31 bp, Pepper Huasteco yellow vein virus
aaaattcgggtctatttttatgactcgataa

SEQ ID NO: 25 - DNA, 21 bp, Artificial Sequence
  Description of Artificial Sequence: Synthetic consensus sequence (Gemini5)
ttcccctgtgcgtgaatccgt

SEQ ID NO: 26 - DNA, 31 bp, Tomato yellow leaf curl virus
aatcatggattcacgcacaggggaactcatc

SEQ ID NO: 27 - DNA, 31 bp, Tomato leaf curl New Delhi virus
gatcacggattcacgcacaggggaatacatc

SEQ ID NO: 28 - DNA, 31 bp, Tomato severe leaf curl virus
aaccatggattcacgcacaggggagagcatc

SEQ ID NO: 29 - DNA, 31 bp, Pepper golden mosaic virus
aataatggattcacgcacaggggagagcatc

SEQ ID NO: 30 - DNA, 31 bp, Pepper Huasteco yellow vein virus
aacaatggatttacgcaccggggtacccatc

SEQ ID NO: 31 - DNA, 21 bp, Artificial Sequence
  Description of Artificial Sequence: Synthetic consensus sequence (Gemini6)
ttccgcctttaatttggattg

SEQ ID NO: 32 - DNA, 31 bp, Tomato yellow leaf curl virus
gcccattcaaattaaagggggaattcccact

SEQ ID NO: 33 - DNA, 31 bp, Tomato leaf curl New Delhi virus
gccggtcatgattaaaggtggaattcccact

SEQ ID NO: 34 - DNA, 31 bp, Tomato severe leaf curl virus
gccagttcaaattaaagggggaataccgtca

SEQ ID NO: 35 - DNA, 31 bp, Pepper golden mosaic virus
gccagttcaaattaaaggcgggataccatca

SEQ ID NO: 36 - DNA, 31 bp, Pepper Huasteco yellow vein virus
accaattcaaattaaaggtgggatacccact

SEQ ID NO: 37 - DNA, 21 bp, Artificial Sequence
  Description of Artificial Sequence: Synthetic consensus sequence (Gemini7)
ttacatgggccttcacagcct

SEQ ID NO: 38 - DNA, 31 bp, Tomato yellow leaf curl virus
ccccgtggatgtgaaggcccatgtaaagtcc

SEQ ID NO: 39 - DNA, 31 bp, Tomato leaf curl New Delhi virus
ccaaggggctgtgaaggcccttgtaaagtgc

SEQ ID NO: 40 - DNA, 31 bp, Tomato severe leaf curl virus
ccaaggggctgtgaaggcccatgtaaggtcc

SEQ ID NO: 41 - DNA, 31 bp, Pepper golden mosaic virus
cctagaggatgtgaagggccatgtaaggtcc

SEQ ID NO: 42 - DNA, 31 bp, Pepper Huasteco yellow vein virus
ccgaaaggttgtgaaggtccctgtaaggttc

SEQ ID NO: 43 - DNA, 22 bp, Artificial Sequence
  Description of Artificial Sequence: Synthetic consensus sequence (TospoL1-1)
tttaggcatcatatagatagct

SEQ ID NO: 44 - DNA, 31 bp, Tomato spotted wilt virus
ttggctatttatatgatgcctaaatcactgc

SEQ ID NO: 45 - DNA, 31 bp, Groundnut bud necrosis virus
ctagcaatctatatgatgcctaaatctttgc

SEQ ID NO: 46 - DNA, 31 bp, Capsicum chlorosis virus
ctagcaatctatatgatgcctaaatcactcc

SEQ ID NO: 47 - DNA, 21 bp, Artificial Sequence
  Description of Artificial Sequence: Synthetic consensus sequence (Tospo L1-2)
tgatttaggcatcatatagat

SEQ ID NO: 48 - DNA, 31 bp, Tomato spotted wilt virus; identical to SEQ ID NO: 44

SEQ ID NO: 49 - DNA, 31 bp, Groundnut bud necrosis virus; identical to SEQ ID NO: 45

SEQ ID NO: 50 - DNA, 31 bp, Capsicum chlorosis virus; identical to SEQ ID NO: 46

SEQ ID NO: 51 - DNA, 21 bp, Artificial Sequence
  Description of Artificial Sequence: Synthetic consensus sequence (Tospo M1)
tatctatattttccatctacc

SEQ ID NO: 52 - DNA, 31 bp, Tomato spotted wilt virus
tgttgtagacgggaaatatagatatatgata

SEQ ID NO: 53 - DNA, 31 bp, Groundnut bud necrosis virus
tgaagtagatgggaaatatagatatctttta

SEQ ID NO: 54 - DNA, 31 bp, Capsicum chlorosis virus
agaggttgatggaaaatacagatatcttata

SEQ ID NO: 55 - DNA, 21 bp, Artificial Sequence
  Description of Artificial Sequence: Synthetic consensus sequence (Tospo M2)
ttagtttgcaggcttcaatta

SEQ ID NO: 56 - DNA, 31 bp, Tomato spotted wilt virus
cattcattgaagcctgcaagctgataattcc

SEQ ID NO: 57 - DNA, 31 bp, Groundnut bud necrosis virus
ctctaattgaagcatgcaaattaatgatacc

SEQ ID NO: 58 - DNA, 31 bp, Capsicum chlorosis virus
ctttgattgaagcatgcaaattaatgatacc

SEQ ID NO: 59 - DNA, 21 bp, Artificial Sequence
  Description of Artificial Sequence: Synthetic consensus sequence (Tospo M3)
ttgcatgcttcaatgagagct

SEQ ID NO: 60 - DNA, 31 bp, Tomato spotted wilt virus
tctcaggcattcattgaagcctgcaagctga

SEQ ID NO: 61 - DNA, 31 bp, Groundnut bud necrosis virus
gctgctgctctaattgaagcatgcaaattaa

SEQ ID NO: 62 - DNA, 31 bp, Capsicum chlorosis virus
gctgctgctttgattgaagcatgcaaattaa

SEQ ID NO: 63 - DNA, 21 bp, Artificial Sequence
  Description of Artificial Sequence: Synthetic consensus sequence (Tospo S2)
ttgacgttagacatggtgttt

SEQ ID NO: 64 - DNA, 31 bp, Tomato spotted wilt virus
acgatcatcatgtctaaggttaagctcacta

SEQ ID NO: 65 - DNA, 31 bp, Groundnut bud necrosis virus
gtaaacaccatgtctaacgtcaagcaactca

SEQ ID NO: 66 - DNA, 31 bp, Capsicum chlorosis virus
gtaaacaccatgtctaacgtcaggcaactta

SEQ ID NO: 67 - DNA, 21 bp, Artificial Sequence
  Description of Artificial Sequence: Synthetic consensus sequence (Tospo S3)
tagaaagttttgaagttgaat

SEQ ID NO: 68 - DNA, 31 bp, Tomato spotted wilt virus
ggtagcattcaacttcaagactttttgtctg

SEQ ID NO: 69 - DNA, 31 bp, Groundnut bud necrosis virus
tcccggatttagctttaaagctttctatgac

SEQ ID NO: 70 - DNA, 31 bp, Capsicum chlorosis virus
tccaggattcaacttcaagacattttatgat

SEQ ID NO: 71 - DNA, 21 bp, Pepino mosaic virus
  consensus sequence (PepMV1)
tcttcattgtagttaatggag

SEQ ID NO: 72 - DNA, 31 bp, Pepino mosaic virus
atatactccattaactacaatgaagaaggct

SEQ ID NO: 73 - DNA, 31 bp, Pepino mosaic virus
atttactccattaactacaatgaagaaggct

SEQ ID NO: 74 - DNA, 31 bp, Pepino mosaic virus; identical to SEQ ID NO: 72

SEQ ID NO: 75 - DNA, 31 bp, Pepino mosaic virus
atatactccattaactacaatgaagaaggtt

SEQ ID NO: 76 - DNA, 31 bp, Pepino mosaic virus
atatactccattaattacaatgaagaaggtt

SEQ ID NO: 77 - DNA, 31 bp, Pepino mosaic virus; identical to SEQ ID NO: 76

SEQ ID NO: 78 - DNA, 31 bp, Pepino mosaic virus; identical to SEQ ID NO: 73

SEQ ID NO: 79 - DNA, 31 bp, Pepino mosaic virus; identical to SEQ ID NO: 73

SEQ ID NO: 80 - DNA, 31 bp, Pepino mosaic virus; identical to SEQ ID NO: 73

SEQ ID NO: 81 - DNA, 31 bp, Pepino mosaic virus; identical to SEQ ID NO: 73

SEQ ID NO: 82 - DNA, 31 bp, Pepino mosaic virus; identical to SEQ ID NO: 73

SEQ ID NO: 83 - DNA, 31 bp, Pepino mosaic virus; identical to SEQ ID NO: 73

SEQ ID NO: 84 - DNA, 31 bp, Pepino mosaic virus; identical to SEQ ID NO: 76

SEQ ID NO: 85 - DNA, 21 bp, Pepino mosaic virus
  consensus sequence (PepMV2)
ttggaagaggaaaaggtggtt

SEQ ID NO: 86 - DNA, 31 bp, Pepino mosaic virus
gcgccaaccaccttttccttttccaaagagg

SEQ ID NO: 87 - DNA, 31 bp, Pepino mosaic virus
gtgccaaccaccttttcctcttccaaagagg

SEQ ID NO: 88 - DNA, 31 bp, Pepino mosaic virus; identical to SEQ ID NO: 86

SEQ ID NO: 89 - DNA, 31 bp, Pepino mosaic virus
gagccaaccaccttttcctcttccaaagagg

SEQ ID NO: 90 - DNA, 31 bp, Pepino mosaic virus
gagccaaccatcttttcctcttccaaagagg

SEQ ID NO: 91 - DNA, 31 bp, Pepino mosaic virus; identical to SEQ ID NO: 90

SEQ ID NO: 92 - DNA, 31 bp, Pepino mosaic virus; identical to SEQ ID NO: 87

SEQ ID NO: 93 - DNA, 31 bp, Pepino mosaic virus; identical to SEQ ID NO: 87

SEQ ID NO: 94 - DNA, 31 bp, Pepino mosaic virus; identical to SEQ ID NO: 87

SEQ ID NO: 95 - DNA, 31 bp, Pepino mosaic virus
gtgccaaccaccttttccttttccaaagagg

SEQ ID NO: 96 - DNA, 31 bp, Pepino mosaic virus; identical to SEQ ID NO: 87

SEQ ID NO: 97 - DNA, 31 bp, Pepino mosaic virus; identical to SEQ ID NO: 95

SEQ ID NO: 98 - DNA, 31 bp, Pepino mosaic virus; identical to SEQ ID NO: 90

SEQ ID NO: 99 - DNA, 21 bp, Pepino mosaic virus
  consensus sequence (PepMV3)
tcaatcatgcacctccagtcg

SEQ ID NO: 100 - DNA, 31 bp, Pepino mosaic virus
caacaagactggaggtgcatgattgaaytct

SEQ ID NO: 101 - DNA, 31 bp, Pepino mosaic virus
caacacgactggaggtgcatgattgaattct

SEQ ID NO: 102 - DNA, 31 bp, Pepino mosaic virus; identical to SEQ ID NO: 101

SEQ ID NO: 103 - DNA, 31 bp, Pepino mosaic virus
caacatgactggaggtgcatgattgaattct

SEQ ID NO: 104 - DNA, 31 bp, Pepino mosaic virus; identical to SEQ ID NO: 103

SEQ ID NO: 105 - DNA, 31 bp, Pepino mosaic virus; identical to SEQ ID NO: 103

SEQ ID NO: 106 - DNA, 31 bp, Pepino mosaic virus; identical to SEQ ID NO: 101

SEQ ID NO: 107 - DNA, 31 bp, Pepino mosaic virus; identical to SEQ ID NO: 101

SEQ ID NO: 108 - DNA, 31 bp, Pepino mosaic virus
caacacgactggaggtgcatgattggattct

SEQ ID NO: 109 - DNA, 31 bp, Pepino mosaic virus; identical to SEQ ID NO: 101

SEQ ID NO: 110 - DNA, 31 bp, Pepino mosaic virus; identical to SEQ ID NO: 101

SEQ ID NO: 111 - DNA, 31 bp, Pepino mosaic virus; identical to SEQ ID NO: 101

SEQ ID NO: 112 - DNA, 31 bp, Pepino mosaic virus; identical to SEQ ID NO: 103

SEQ ID NO: 113 - DNA, 21 bp, Artificial Sequence
  Description of Artificial Sequence: Synthetic consensus sequence (PepMV4)
taagtagcaaggcctaggtga

SEQ ID NO: 114 - DNA, 31 bp, Pepino mosaic virus
taggatcacctaggccttgttatttagataa

SEQ ID NO: 115 - DNA, 31 bp, Pepino mosaic virus
taggttcacctaggccttgctatttagataa

SEQ ID NO: 116 - DNA, 31 bp, Pepino mosaic virus
taggatcacctaggccttgttacttagataa

SEQ ID NO: 117 - DNA, 31 bp, Pepino mosaic virus
taggttcacctaggccttgttacttagataa

SEQ ID NO: 118 - DNA, 31 bp, Pepino mosaic virus; identical to SEQ ID NO: 114

SEQ ID NO: 119 - DNA, 31 bp, Pepino mosaic virus; identical to SEQ ID NO: 117

SEQ ID NO: 120 - DNA, 31 bp, Pepino mosaic virus; identical to SEQ ID NO: 115

SEQ ID NO: 121 - DNA, 31 bp, Pepino mosaic virus; identical to SEQ ID NO: 115

SEQ ID NO: 122 - DNA, 31 bp, Pepino mosaic virus; identical to SEQ ID NO: 115

SEQ ID NO: 123 - DNA, 31 bp, Pepino mosaic virus
taggttcacctaggccttgttatttagacaa

SEQ ID NO: 124 - DNA, 31 bp, Pepino mosaic virus; identical to SEQ ID NO: 115

SEQ ID NO: 125 - DNA, 31 bp, Pepino mosaic virus; identical to SEQ ID NO: 123

SEQ ID NO: 126 - DNA, 31 bp, Pepino mosaic virus; identical to SEQ ID NO: 117

SEQ ID NO: 127 - DNA, 21 bp, Pepino mosaic virus
  consensus sequence (PepMV5)
tttggaagtaaatgcaggctg

SEQ ID NO: 128 - DNA, 31 bp, Pepino mosaic virus
gttgtcagcttgcatttacttccaaaacagc

SEQ ID NO: 129 - DNA, 31 bp, Pepino mosaic virus
gttgtcagcttgcatttacttccaaaatagc

SEQ ID NO: 130 - DNA, 31 bp, Pepino mosaic virus; identical to SEQ ID NO: 128

SEQ ID NO: 131 - DNA, 31 bp, Pepino mosaic virus
actgtcagcttgcatttacttccaaaacagt

SEQ ID NO: 132 - DNA, 31 bp, Pepino mosaic virus; identical to SEQ ID NO: 131

SEQ ID NO: 133 - DNA, 31 bp, Pepino mosaic virus; identical to SEQ ID NO: 131

SEQ ID NO: 134 - DNA, 31 bp, Pepino mosaic virus; identical to SEQ ID NO: 129

SEQ ID NO: 135 - DNA, 31 bp, Pepino mosaic virus; identical to SEQ ID NO: 129

SEQ ID NO: 136 - DNA, 31 bp, Pepino mosaic virus; identical to SEQ ID NO: 129

SEQ ID NO: 137 - DNA, 31 bp, Pepino mosaic virus
gttgtcagcctgcatttacttccaaaatagc

SEQ ID NO: 138 - DNA, 31 bp, Pepino mosaic virus; identical to SEQ ID NO: 129

SEQ ID NO: 139 - DNA, 31 bp, Pepino mosaic virus; identical to SEQ ID NO: 137

SEQ ID NO: 140 - DNA, 31 bp, Pepino mosaic virus; identical to SEQ ID NO: 131

SEQ ID NO: 141 - DNA, 22 bp, Pepino mosaic virus
  consensus sequence (PepMV6)
taacccgttccaaggggagaag

SEQ ID NO: 142 - DNA, 31 bp, Pepino mosaic virus
tcaacttctccccttggaacgggttaagttt

SEQ ID NO: 143 - DNA, 31 bp, Pepino mosaic virus; identical to SEQ ID NO: 142

SEQ ID NO: 144 - DNA, 31 bp, Pepino mosaic virus; identical to SEQ ID NO: 142

SEQ ID NO: 145 - DNA, 31 bp, Pepino mosaic virus; identical to SEQ ID NO: 142

SEQ ID NO: 146 - DNA, 31 bp, Pepino mosaic virus; identical to SEQ ID NO: 142

SEQ ID NO: 147 - DNA, 31 bp, Pepino mosaic virus; identical to SEQ ID NO: 142

SEQ ID NO: 148 - DNA, 31 bp, Pepino mosaic virus; identical to SEQ ID NO: 142

SEQ ID NO: 149 - DNA, 31 bp, Pepino mosaic virus; identical to SEQ ID NO: 142

SEQ ID NO: 150 - DNA, 31 bp, Pepino mosaic virus; identical to SEQ ID NO: 142

SEQ ID NO: 151 - DNA, 31 bp, Pepino mosaic virus
tcaacttctccccctggaacgggttaagttt

SEQ ID NO: 152 - DNA, 31 bp, Pepino mosaic virus
taaacttctccccttggaacgggttaagttt

SEQ ID NO: 153 - DNA, 31 bp, Pepino mosaic virus; identical to SEQ ID NO: 151

SEQ ID NO: 154 - DNA, 31 bp, Pepino mosaic virus; identical to SEQ ID NO: 142

SEQ ID NO: 155 - DNA, 336 bp, Glycine max
  (MON1)
aattcattacattgataaaacacaattcaaaagatcaatgttccacttcatgcaaagacatttccaaaatatgtgtaggtagaggggttttacaggatcgtcctgagaccaaatgagcagctgaccacatgatgcagctatgtttgctattcagctgctcatctgttctcaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 156 - DNA, 336 bp, Artificial Sequence
  Description of Artificial Sequence: Synthetic chimeric sequence from soybean and Geminivirus: (Gemini1/MON1)
aattcattacattgataaaacacaattcaaaagatcaatgttccacttcatgcaaagacatttccaaaatatgtgtaggtagaggggttttacaggatcgtcctgtcatcaatgacgttgtactccacatgatgcagctatgtttgctatagtacaacgtcactgttgataggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 157 - DNA, 383 bp, Glycine max
  (MON5)
cgaagagctgggaacgggagattggagcaatcagaatttgtgggaatgggctgattgggaagcaatgtgtgctggtgcaatgcatttaatttcttcccaattccgcccattcctatgatttctgatgattctttcctttccttttgctttttgcaatacgcaatatgcatgtaccttatttttcattccatcctcattattctatgctaatggatagtacttccttcttctccatgtttcttttattgttataacaacacatgataaaattgtaatatgaaacataacttctgcagcctaatttgtttttttcgtgcatttgataaacggcgttggagaaggagtttatgttgtcatatgaattaaagggaagcacttttaaa

SEQ ID NO: 158 - DNA, 236 bp, Artificial Sequence
  Description of Artificial Sequence: Synthetic chimeric sequence from soybean and Geminivirus (Gemini4/MON5)
cgaagagctgggaacgggagattggagcaatcagaatttgtaatccggatcgcttctatgagcaatgtgtgctggtgcaatgcatttaatttctcatagaagtagatccggattatgatttctgatgattctttcctttccttttgctttttgcaatacgcaatatgcatgtaccttatttttcattccatcctcattattctatgctaatggatagtacttccttcttctccatg

SEQ ID NO: 159 - DNA, 408 bp, Oryza sativa
  (MON13)
ggcagagccgtgcccgtctcatcccctgcccgtgcaagcagctaggtaggacgatttgagcgtggtgttaggccgaaccgctgaaggaagattgctccactgttgactgcattaggattcaatccttgctgctaaatgtattgcttatattcagcaatataatgttcagcagcaagaactggatcttaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 160 - DNA, 295 bp, Artificial Sequence
  Description of Artificial Sequence: Synthetic chimeric sequence (Gemini7/MON13)
ggcagagccgtgcccgtctcatcccctgcccgtgcaagcagctaggtaggacgatttgagcgtggtgttaggccgaaccgctgaaggaagattgctccactgttgactgcatttacatgggccttcacagcctaaatgtattgcttatattcagcaatataatgttcaggctgtgactacccatgtaaatatagtcgatagtggaagaacggtaacatatgtggtttgcagcaggtgagcaggatgggtgtggatgattgaatatctctgttcagtgttttcatcatctgactga

SEQ ID NO: 161 - DNA, 485 bp, Zea mays
  (MON18)
catcaggtaggcgcggcgcggaccgcaacacgccagctttcttgctcttgtctctaagcagcagcagcttcctgtctctccagccaccattccattctcgctccttggtaatgaggctggctagccagctaatgcagctccgaacctgttttgttggtggtcatttaaccatgcatgcttcgatcgatggattggtgcatgcatggattattgcatagtgtgatgcatgtggcgcatcagtgcatggttagatgaccatcagcaaacatgttcttgaggcatgcaagttctctagctacacatatcagagatcgatcaccactgcggcgccatggctacttaattgaaatggaggtttgcatttctccgaacccggatgtcgtgattctgcttccgttcttgatccaggatcttccggtcttgttcccaccattactttccttaggaaactggaatggtttcaaccttaatttgtttgtgtgtgt

SEQ ID NO: 162 - DNA, 295 bp, Artificial Sequence
  Description of Artificial Sequence: Synthetic chimeric sequence from maize and Pepino mosaic virus (PepMV5/MON18)
agcagcagcttcctgtctctccagccaccattccattctcgctccttggtaatgaggctggctagccagctaatgcagctccgaacccagccttgcatttacttccaaaccatgcatgcttcgatcgatggattggtgcatgcatggattattgcatagtgtgatgcatgtggcgcatcagtgcatggtttggaagtaaatgcaggctgtgttcttgaggcatgcaagttctctagctacacatatcagagatcgatcaccactgcggcgccatggctacttaattgaaatggag

SEQ ID NO: 163 - DNA, 483 bp, Zea mays
  (miR159a)
gcatctgctgttctttatttctatacatacatatatactatcatcggttatttgcttctctattctgtccgagtactttacggtgttccgcacatagatctcgtggccggctgttttgcgctttcgcttgcgtttcttggccctgctggtgttgaccggtccgaacgggggcagatcgatgctttgggtttgaagcggagctcctatcattccaatgaagggtcgttccgaagggctggttccgctgctcgttcatggttcccactatcctatctcatcatgtgtatatatgtaatccatgggggagggtttctctcgtctttgagataggcttgtggtttgcatgaccgaggagctgcaccgcccccttgctggccgctctttggattgaagggagctctgcatcctgatccacccctccattttttttgcttgttgtgtccttcctgggacctgagatctgaggctcgtggtggctcactg

SEQ ID NO: 164 - DNA, 354 bp, Artificial Sequence
  Description of Artificial Sequence: Synthetic chimeric sequence (Gemini6/miR159a)
cgctttcgcttgcgtttcttggccctgctggtgttgaccggtccgaacgggggcagatcgatgctttgggtttgaagcaatccaaatgaaatgtggatgaagggtcgttccgaagggctggttccgctgctcgttcatggttcccactatcctatctcatcatgtgtatatatgtaatccatgggggagggtttctctcgtctttgagataggcttgtggtttgcatgaccgaggagctgcaccgcccccttgctggccgctcttccgcctttaatttggattgcatcctgatccacccctccattttttttgcttgttgtgtccttcctgggacctgagatctgaggctcgtg

SEQ ID NO: 165 - DNA, 580 bp, Zea mays
  (miR167g)
acgagagggtatgtagtggtgcaccacgagttggtgaagctgccagcatgatctggttctgatggtggtggtatatgtaagatggatgtaatctatactacggcccctgttaatttctctctctctccccggtccctgactgtcatatatggatcgacgaatccaagatgagaggggaatggagagagagagagagggtaattatgagcaccaggaccaggtcatgctgtagtttcatctgctggtggccgcacatcgaaaaccctagctagctctagtagctagctcatcctcgtgcaattcatatccatgctgcactcgccagaccaccagtcaagctagcttatttccgccgttgacgacgttgattaattattcgtgataataatagccttgtcgatctagtttcgtctctctctttttattattatgcctttgcttctctcttggttcggttgtgtattgctgtcttggtcatcactgtgtgcctacatacgatttcactgtgtgatccttcctgctcacgataatgcagatggtgggaagctgtgcattgccggaagtcttcttttcgaaggtc

SEQ ID NO: 166 - DNA, 350 bp, Artificial Sequence
  Description of Artificial Sequence: Synthetic chimeric sequence (PepMV6/miR167g)
acgagagggtatgtagtggtgcaccacgagttggtaacccgttccaaggggagaagttctgatggtggtggtatatgtaagatggatgtaatctatactacggcccctgttaatttctctctctctccccggtccctgactgtcatatatggatcgacgaatccaagatgagaggggaatggagagagagagagagggtaattatgagcaccaggacttctccccttggacgggttatctgctggtggccgcacatcgaaaaccctagctagctctagtagctagctcatcctcgtgcaattcatatccatgctgcactcgccagaccaccagtcaagctagcttatttc

SEQ ID NO: 167 - RNA, 10 nt, Artificial Sequence
  Description of Artificial Sequence: Synthetic oligonucleotide
ucucguuagc

SEQ ID NO: 168 - RNA, 10 nt, Artificial Sequence
  Description of Artificial Sequence: Synthetic oligonucleotide
agagcaaucg

SEQ ID NO: 169 - DNA, 2781 bp, Tomato yellow leaf curl virus
accggatggccgcgccttttccttttatgtggtccccacgagggttacacagacgtcactgtcaaccaatcaaattgcatcctcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcaaccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcagcgggatgatattaagcacactggtgttgttcgttgtgttagtgatgttactcgtggatctggaattactcacagagtcggtaagaggttctgtgttaaatcgatatattttttaggtaaagtctggatggatgaaaatatcaagaagcagaatcacactaatcaggtcatgttctttttggtccgtgatagaaggccctatggaagcagtccaatggattttggacaggtttttaatatgttcgataatgagcccagtaccgcaactgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattacaccaagactatctaaatacttaagaacttcatatctagatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctggctgtggtctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccatctgggcccccatgaattccttgaagtgctttaaatagtgcgggtctacgtcatcaatgacgttgtaccacgcatcattactgtacacctttgggcttaggtctagatgtccacataaataattatgtgggcctaaagacctggcccacattgttttgcctgttctgctatcaccctcaatgacaatacttatgggtctccatggccgcgcagcggaatacacgacattctcggcgacccactcttcaagttcatctggaacttgattaaaagaagaagaaagaaatggagaaacataaacttctaaaggaggattaaaaatcctatctaaatttgaacttaaattatgaaattgtaaaatatagtcctttggggccttttcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgtttggatggaaatgtgctgacctgtttggggataccaggtcgaagaaccgttggttcttacattggtatttgccttcgaattggataagcacatggagatgtggttccccattctcgtggaattctctgcaaactttgatgtattttttatttgttggggtttctatgttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttacttatacctggacacctaatggctatttggtaatttcataaatgttcattgcaattcaaaattcaaaattcaaaaatcaaatcattaaagcggtcatccgtataatatt

SEQ ID NO: 170 - DNA, 2787 bp, Tomato yellow leaf curl virus
gttgaaatgaatcggtgtccctcaaagctctatggcaatcggtgtatcggtgtcttacttatacttggacacctaatggctatttggtaatttcataaatgttcatttcaattcaaaattcaaaattcaaaaatcaaatcattaaagcggccatccgtataatattaccggatggccgcgccttttccttttatgtggtccccacgagggttacacagatgttattgtcaaccaatcaaattgcattctcaaacgttagataagtgttcatttgtctttatatacttggtccccaagttttttgtcttgcaatatgtgggacccacttcttaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagcccaatggattttggacaggtttttaatatgttcgataatgagcccagtaccgcaaccgtgaagaatgatttgcgtgataggtttcaagtgatgaggaaatttcatgctacagttattggtgggccctctggaatgaaggaacaggcattagttaagagattttttaaaattaacagtcatgtaactttatttatattcattcaggaggcagcaaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaatggaaattacaccaagactatctaaatacttaagaacttcatatctaaatactcttaagaaatgaccagtctgaggctgtaatgtcgtccaaattcggaagtcgagaaaacatttgtgaatccccattaccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgacaatacttatgggtctccatggccgcgcagcggaatacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttgggaaactccaaaatcaatgaagtttccgtctttctccacgtaggtcttgacatctgttgagctcttagctgcctgaatgttcggatggaaatgtgctgacctgtttggggataccaagtcgaagaaccgttggttcttacattggtatttgccttcgaattggataagcacatggagatgtggttccccattctcgtggagttctttgcaaactttgatgtattttttatttgttggggtttctagtttttttaattgggaaagtgcttcctctttagagagagaacaattgggatatgttaggaaataatttttggcatatattttaaataaacgaggcat

SEQ ID NO: 171 - DNA, 2790 bp, Tomato yellow leaf curl virus
atggtcaatgagtaccgattgaccaagatttttacacttatccctggtgtatcggtactcaatatatagtgagtaccaaatggcattttggtaataacataaaagtacattgcaattcaaaattcaaataaaaaaatcaaatcattaaagccggccatccgtataatattaccggagctcggcgcctttttcttttatgctggtccccacgaggttccactgacgtcactgtcaaccaatcaaattgcatcctcaaacgttagatagtgtttatttgtctttatatacttggtccccaagttttttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgcggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaatggaaattacaccaagactatctaaatacttaataacttcatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctgtggctgtgttctgttatcttgaaatataggggattgtttatctcccagataaaaacgccattctctgcctgaggagcagtgatgagttcccctgtgcgtgaatccatgattactgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgataatactgttaggtctccatggccgcgcagcggaagacatgacgttctcggacacccatacttcaagttcatctggaacttgattaaaagatgaagataaaaagggagaaatataaggagccggaggctcctgaaaaattctatctaaattactatttaaattatgaaactgtaaaatataatctttcggtactaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcctggggataccaggtcgaagaatcgctgattttggcatttgaatttcccttcaaattggataagcacatggagatgtggttccccattctcgtggagttctctgcaaactttgatgtattttttatttgttggggtttctaggttttttaattgggaaagtgcttcttcgtttgttaaggagcaatgaggatatgtgaggaaataatttttgcaatttatttggaagcgcttaggaggagccat

SEQ ID NO: 172 - DNA, 2791 bp, Tomato yellow leaf curl virus
atggtcaatgagtaccgattgaccaagatttttacacttatccctggtgtatcggtactcaatatatagtgagtaccaaatggcattttggtaattttgtaaaagtacattgcaattcaaaattcaaaattcaaaaatcaaatcattaaagcggccatccgtataatattaccggatggccgcgccttttccttttatgtggtccccatgaaggttccacagacgtcactgtcaaccaatcaaattgcatccttaaacgttagataagtgtgcatttgtctttatatacttgctccccaagtagtttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaggcccatgtaaagtacagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaaccacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtggtccctctggaatgaaggaacaggcattagttaagagattttttagaattaacagtcatgtaacttataatcatcaggaggcagccaagtacgataaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggatgtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccatgcatcattactgtacacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatctttcggtattaattctttaatgattctaagagcctctgacttactgcctgagttaagagctgcggcgtaagcgtcattggctgactgctgacccccacgtgcagatcgtccgtcgatctgaaactcaccccagtcgacggtgtttccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgtgggggtttctaggttttttaattgggaaagtgcttcttctttcgttaaggagcacttaggatatgtgaggaaataatttttgcaatttatttggaagcgcttgggaggagccat

SEQ ID NO: 173 - DNA, 2787 bp, Tomato yellow leaf curl virus
atggtcaatgagtaccgattgaccaagatttttacacttatccctggtgtatcggtactcaatatatagtgagtaccaaatggcattttggtaattttgtaaaagtacattgcaattcaaaattcaaaattcaaaaatcaaatcattaaagcggccatccgtataatattaccggatggccgcgcctttaactttatgcccggtccccacgagggttccacagtctattaaccaatcaaattgcatcctcaaacgttagataagtgttcatttgtctttatatacttggtccccaagtattttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaagcccatgtaaagtacagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtcttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccagtaccttcctgatgttgtggttgaatcttatctgaatggaaatgatgtcgtggttcattagaaatggcctctggctgtgttctgttatcttgaaatagaggggattgtttatctcccagataaaaacgccattctctgcttgaggagcagtgatgagttcccctgtgcgtgaatccatgattgttgcagttgaggtggaggtagtatgagcagccacagtctaggtttacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttggacttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatcttttggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggtcttttaattgggaaagtgcttcttctttcgttaaggagcacttaggatatgtgaggaaataatttttgcaatttatttggaagcgcttagggggagccat

SEQ ID NO: 174 - DNA, 2774 bp, Tomato yellow leaf curl virus
gttgaaatgaatcggtgtccctcaaagctctatggcaatcggtgtatcggtgtcttacttatacctggacacctaatggctatttggtaatttcatgaatgttcattgtaattcaaaattcaaaaatcaaatcattaaagcggccatccgtataatattaccggatggccgcgccttttccttttatgtggtccccacgagggttacatagacgtcactgtcaaccaatcaaattgcatcctcaaacgttagataagtgttcatttgtctttatatacttggtccccaagttttttgtcttgcaatatgtgggacccacttcttaatgagtttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttagggaaagtctggatggatgaaaatatcaagaagcagaatcatactaatcaggtcatgttcttcttagtccgtgatagaaggccctatggaagcagcccaatggattttggacaggtttttaatatgttcgataatgagcccagtaccgcaaccgtgaagaatgatttgcgggataggtttcaagtgatgaggaaatttcatgctacagttattggtggaccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgatctgattacattgttaatggaaattacaccaagactatctaaatacttaagaacttcatatctaaatactcttaagaaatgaccagtctgaggctgtaatgtcgtccaaattcggaagttgagaaaacatttgtgaatccccatgaccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagtccaatttttcaaggatatgtttttttcttcgtctagatattccctatatgaggaggtaggtcctggattgcagaggaagatagtgggaattccccctttaatttgaatgggcttcccgtactttgtgttgctttgccagtccctttgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttccctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatcctacctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctttgcaaactttgatgtattttttatttgttggggtttctaggttttttaattgggaaagtgcttcctctttagagagagaacaattgggatatgttaggaaataatttttggcatatatattaaataaacgaggcat

SEQ ID NO: 175 - DNA, 2791 bp, Tomato yellow leaf curl virus
atggtcaatgagtaccgattgaccaagatttttacacttatccctggtgtatcggtactcaatatatagtgagtaccaaatggcattttggtaattttgtaaaagtacattgcaattcaaaattcaaaattcaaaaatcaaatcattaaagcggccatccgtataatattaccggatggccgcgccttttccttttatgtggtccccatgaaggttccacagacgtcactgtcaaccaatcaaattgcatccttaaacgttagataagtgtgcatttgtctttatatacttgctccccaagtagtttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaggcccatgtaaagtacagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaaccacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtggtccctctggaatgaaggaacaggcattagttaagagattttttagaattaacagtcatgtaacttataatcatcaggaggcagccaagtacgataaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccatgcatcattactgtacacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggggaaatataaggagccggaggctcctgaaaaattctatctaaattactatttaaattatgaaattgtaaaatataatctttcggtattaattctttaatgattctaagagcctctgacttactgcctgagttaagagctgcggcgtaagcgtcattggctgactgctgacccccacgtgcagatcgtccgtcgatctgaaactcaccccagtcgacggtgtttccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgtgggggtttctaggttttttaattgggaaagtgcttcttctttcgttaaggagcacttaggatatgtgaggaaataatttttgcaatttatttggaagcgcttgggaggagccat

SEQ ID NO: 176 - DNA, 2774 bp, Tomato yellow leaf curl virus
gttgatatgaatcggtgtccctcaaagctctatggcaatcggtgtatcggtgtcttatttatacctggacacctaatggctatttggtaatttcatgaatgttcattgtaattcaaaattcaaaaatcaaatcattaaagcggccatccgtataatattaccggatggccgcgccttttccttttatgtggtccccacgagggttacacagacgtcactgtcaaccaatcaaattgcatcctcaaacgttagataagtgttcatttgtctttatatacttggtccccaagttttttgtcttgcaatatgtgggacccacttcttaatgagtttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttagggaaagtctggatggatgaaaatatcaagaagcagaatcacactaatcaggtcatgttcttcttagtccgtgatagaaggccctatggaagcagcccaatggattttggacaggtttttaatatgttcgataatgagcccagtaccgcaaccgtgaagaatgatttgcgggataggtttcaagtgatgaggaaatttcatgctacagttattggtggaccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgatctgattacattgttaatggaaattacaccaagactatctaaatacttaagaacttcatatctaaatactcttaagaaatgaccagtctgaggctgtaatgtcgtccaaattcggaagttgagaaaacatttgtgaatccccatgaccttcctgatgttgtggttgaatcttatctgaatggaaatgatgtcgtggttcattagaaatcgcctctggctgtgttctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagtccaatttttcaaggatatgtttttttcttcgtctagatattccctatatgaggaggtaggtcctggattgcagaggaagatagtgggaattccccctttaatttgaatgggcttcccgtattttgtgttgctttgccagtccctttgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttccctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaaggaccgttggttcttacattggtatttgccttcgaattggataagcacatggagatgtggttccccattctcgtggagttctttgcaaactttgatgtattttttatttgttggggtttctaggttttttaattgggaaagtgcttcctctttagagagagaacaattgggatatgttaggaaataatttttggcatatatattaaataaacgaggcat

SEQ ID NO: 177 - DNA, 2774 bp, Tomato yellow leaf curl virus
gttgaaatgaatcggtgtccctcaaagctctatggcaatcggtgtatcggtgtcttacttatacctggacacctaatggctatttggtaatttcatgaatgttcattgtaattcaaaattcaaaaatcaaatcattaaagcggccatccgtataatattaccggatggccgcgccttttccttttatgtggtccccacgagggttacacagacgtcactgtcaaccaatcaaattgcatcctcaaacgttagataagtgttcatttgtctttatatacttggtccccaagttttttgtcttgcaatatgtgggacccacttcttaatgagtttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttagggaaagtctggatggatgaaaatatcaagaagcagaatcacactaatcaggtcatgttcttcttagtccgtgatagaaggccctatggaagcagcccaatggattttggacaggtttttaatatgttcgataatgagcccagtaccgcaaccgtgaagaatgatttgcgggataggtttcaagtgatgaggaaatttcatgctacagttattggtggaccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgatctgattacattgttaatggaaattacaccaagactatctaaatacttaagaacttcatatctaaatactcttaagaaatgaccagtctgaggctgtaatgtcgtccaaattcggaagttgagaaaacatttgtgaatccccatgaccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagtccaatttttcaaggatatgtttttttcttcgtctagatattccctatatgaggaggtaggtcctggattgcagaggaagatagtgggaattccccctttaatttgaatgggcttcccgtactttgtgttgctttgccagtccctttgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttccctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctttgcaaactttgatgtattttttatttgttggggtttctaggttttttaattgggaaagtgcttcctctttagagagagaacaattgggatatgttaggaaataatttttggcatatatattaaataaacgaggcat

SEQ ID NO: 178 - DNA, 2774 bp, Tomato yellow leaf curl virus
gttgaaatgaatcggtgtccctcaaagctctatggcaatcggtgtatcggtgtcttacttatacctggacacctaatggctatttggtaatttcatgaatgttcattgtaattcaaaattcaaaaatcaaatcattaaagcggccatccgtataatattaccggatggccgcgccttttccttttatgtggtccccacgagggttacacagacgtcactgtcaaccaatcaaattgcatcctcaaacgttagataagtgttcatttgtctttatatacttggtccccaagttttttgtcttgcaatatgtgggacccacttcttaatgagtttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttagggaaagtctggatggatgaaaatatcaagaagcagaatcacactaatcaggtcatgttcttcttagtccgtgatagaaggccctatggaagcagcccaatggattttggacaggtttttaatatgttcgataatgagcccagtaccgcaaccgtgaagaatgatttgcgggataggtttcaagtgatgaggaaatttcatgctacagttattggtggaccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttttatgattcaatatcaaattaataaaatttatattttatatcatgagtttctgttacatttattgtgttttcaagtacatcatacaatacatgatcaactgatctgattacattgttaatggaaattacaccaagactatctaaatacttaagaacttcatatctaaatactcttaagaaatgaccagtctgaggctgtaatgtcgtccaaattcggaagttgagaaaacatttgtgaatccccatgaccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagtccaatttttcaaggatatgtttttttcttcgtctagatattccctatatgaggaggtaggtcctggattgcagaggaagatagtgggaattccccctttaatttgaatgggcttcccgtactttgtgttgctttgccagtccctttgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttccctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctttgcaaactttgatgtattttttatttgttggggtttctaggttttttaattgggaaagtgcttcctctttagagagagaacaattgggatatgttaggaaataatttttggcatatatattaaataaacgaggcat

SEQ ID NO: 179 - DNA, 2791 bp, Tomato yellow leaf curl virus
atggccaatgagtaccgattgaccaagatttttacacttatccctggtatatcggtactcaatatatagtgagtaccaaatggcattttggtaattttgtaaaagtacattgcaattcaaaattcaaaattcaaaaatcaaatcattaaagcggccatccgtataatattaccggatggccgcgccttttccttttatgtggtccccatgaaggttccacagacgtcactgtcaaccaatcaaattgcatccttaaacgttagataagtgtgcatttgtctttatatacttgctccccaagtagtttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagtcctgatattccccgtggatgtgaaggcccatgtaaagtacagtcttatgagcaacgggatgatattaagcatactggtattgttcgttgtgttagtgatgttactcgtggatctggaattactcacagagtgggtaagaggttctgtgttaaatcgatatactttttaggtaaagtctggatggatgaaaatatcaagaagcagaaccacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtggtccctctggaatgaaggaacaggcattagttaagagattttttagaattaacagtcatgtaacttataatcatcaggaggcagccaagtacgataaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccatgcatcattactgtacacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatctttcggtattaattctttaatgattctaagagcctctgacttactgcctgagttaagagctgcggcgtaagcgtcattggctgactgctgacccccacgtgcagatcgtccgtcgatctgaaactcaccccagtcgacggtgtttccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgtgggggtttctaggttttttaattgggaaagtgcttcttctttcgttaaggagcacttaggatatgtgaggaaataatttttgcaatttatttggaagcgcttgggaggaaccat

SEQ ID NO: 180 - DNA, 2787 bp, Tomato yellow leaf curl virus
atggtcaatgagtaccgattgaccaagatttttacacttatccctggtgtatcggtactcaatatatagtgagtaccaaatggcattttggtaattttgtaaaagtacattgcaattcaaaattcaaaattcaaaaatcaaatcattaaagcggccatccgtataatattaccggatggccgcgcctttaactttatgcccggtccccacgaggtttccacagtctattaatcaatcaaattgcatcctcaaacgttagataagtgttcatttgtctttatatacttggtccccaagtattttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaggcccatgtaaagtacagttttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatattaagaagcagaatcacactaatcaggtcatgtttttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtgggccctctggaatgaaggaacaggcattagttaagagattttttagaattaacagtcatgtaactaataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtcttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcttgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacctgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaagtaatgcgggtctacgtcatcaatgacgttgtaccacgcatcattactgtacacctttggacttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatcttttggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggtcttttaattgggaaagtgcttcttctttcgttaaggagcacttaggatatgtgaggaaataatttttgcaatttatttggaagcgcttagggggagccat

SEQ ID NO: 181 - DNA, 2787 bp, Tomato yellow leaf curl virus
atggtcaatgagtaccgattgaccaagatttttacacttatccctggtgtatcggtactcaatatatagtgagtaccaaatggcattttggtaattttgtaaaagtacattgcaattcaaaattcaaaattcaaaaatcaaatcattaaagcggccatccgtataatattaccggatggccgcgtctttaactttatgcccggtccccacgagggttccacagtctattaaccaatcaaattgcatcctcaaacgttagataagtgttcatttgtctttatatacttggtccccaagtattttgtcttgcaatatgtgggatccacttcttaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaggcccatgtaaagtacagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtgggccctctggaatgaaggaacaggcattagttaagagattttttagaattaacagtcatgtaactaataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtcttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcttgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttggacttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatcttttggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggtcttttaattgggaaagtgcttcttctttcgttaaggagcacttaggatatgtgaggaaataatttttgcaatttatttggaagcgcttagggggagccat

SEQ ID NO: 182 - DNA, 2787 bp, Tomato yellow leaf curl virus
atggtcaatgagtaccgattgaccaagatttttacacttatccctggtgtatcggtactcaatatatagtgagtaccaaatggcattttggtaattttgtaaaagtacattgcaattcaaaattcaaaattcaaaaatcaaatcattaaagcggccatccgtataatattaccggatggccgcgcctttaactttatgcccggtccccacgagggttccacagtctattaaccaatcaaattgcatcctcaaacgttagataagtgttcatttgtctttatatacttggtccccaagtattttgtcttgcattatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaggcccatgtaaagtacagttttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtcttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcttgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccataaattccttgaagtgctttaaataatgcgggtctacgtcatcaatgacgttgtaccacgcatcattactgtacacctttggacttaggtctatatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatcttttggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggtcttttaattgggaaagtgcttcttctttcgttaaggagcacttaggatatgtgaggaaataatttttgcaatttatttggaagcgcttagggggagccat

SEQ ID NO: 183 - DNA, 2787 bp, Tomato yellow leaf curl virus
atggtcaatgagtaccgattgaccaagatttttacacttatccctggtgtatcggtactcaatatatagtgagtaccaaatggcattttggtaattttgtaaaagtacattgcaattcaaaattcaaaattcaaaaatcaaatcattaaagcggccatccgtataatattaccggatggccgcgcctttaactttatgcccggtccccacgagggttccacagtctattaaccaatcaaattgcatcctcaaacgttagataagtgttcatttgtctttatatacttggtccccaagtattttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatctgatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaggcccatgtaaagtacagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtcttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaattgcctctggctgtgttctgttatcttgaaatagaggggattgtttatctcccagataaaaacgccattctctgcttgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttggacttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattacgatttaaattatgaaattgtaaaatataatcttttggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggtcttttaattgggaaagtgcttcttctttcgttaaggagcacttaggatatgtgaggaaataatttttgcaatttatttggaagcgcttagggggagccat

SEQ ID NO: 184 - DNA, 2791 bp, Tomato yellow leaf curl virus
taatattaccggatggccgcgccttttccttttatgtggtccccatgagggttcaacagacgtcactgtcaaccaatcaaattgcatcctcaaacgttagataagtgttcatttgtctttatatacttggtccccaagtagtttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagcactgatgttccccgtggatgtgaaggcccatgtaaagtacagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaaccacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtgggccctctggaatgaaggaacaggcattagttaagaggttttttagaattaacagtcatgtaacttataatcatcaggaggcagccaagtacgagaaccatactgaaaacgccttgttattgtatatggcatgtacgcatgcctctaatccagtgtatgctactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaatactatctaaatacttaagaacttgatgtctaaatacttttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattgttgcagttgaggtgttggtagtatgagcagccacagtctaggtctatacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattctttgaagtgctttaaataatgcgggtctacgtcatcaatgacgttgtaccatgcatcattactgtacacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatctttcggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggttttttaattgggaaagtgcttcttctttcgttaaggagcacttaggatatgtgaggaaataatttttgcaatttatttggaagcgcttagggggagccatatggtcaatgagtaccgattgaccaagatttttacacttatccctggtgtatcggtactcaatatatagggagtaccaaatggcatattggtaattttgtaaaagtacaatgcaattcaaaattcaaaattcaaaaatcaaatcattaaagcggccatccgta

SEQ ID NO: 185 - DNA, 2793 bp, Tomato yellow leaf curl virus
taatattaccggatggccgcgccttttgcttttatgcctggtccccacgagggttccacagacgtcactatcaaccaatcaaattgcatcctcaaacgttagataagtgttcatttgtctttatatacttggtccccaagtattttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttccccgtggatgtgaaggcccatgtaaagtacagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagcccaatggattttggacaggtttttaatatgttcgataatgagcccagtaccgcaacagtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtcttttcaagtacatcatacaatacatgatcaactgctctgattacattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcttgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttggacttaggtctagatgtccacataaataattatgtggacctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatctttcggtattaattctttaatgattctaagagcctccgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgtcggggtttctaggtcttttaaatgggaaagtgcttcttctttcgttaaggagcacttaggatatgtgaggaaataatttttgcaatttatttggaagcgcttagggggagccatatggtcaatgagtaccgattgaccaagatttttacacttatccctggtgtatcggtactcaatatatagtgagtaccaaatggcattttggtaattttgtaaaagtacattgcaattcaaaattcaaaatttaaaaatcaaatcattaaagcggccatccgta

SEQ ID NO: 186 - DNA, 2782 bp, Tomato yellow leaf curl virus
taatattaccggatggccgcgctccccgataaagtagtgggccctacgcagtaatttgtgtcgaccaatgaaaatgcagcctcaaagcttaaataatgtatttactttgttataaacttggcttctaagttttgaaaaaaccatcaatatgtgggatcctttattaaatgaatttccagattcagttcatggtctccgttgtatgcttgcaataaaatatttgcagctagttgaagaaacctatgaacccaatactctgggtcatgatctaattagggatctcatttccgtcattcgtgctcgtgactatgccgaagcgaacaggcgatatactaatttcaacgcccgtttcgaaggttcgtcgaaaactgaacttcgacagcccgtataccagccgtgctgctgcccccactgtccaaggcatcaagcgtcgatcatggacttacaggcccatgtatcgaaagccgcggatgtacagaatgtacagaagccctgatgtcccctttggttgtgaaggtccttgtaaagtccagtcgtatgagcagcgtgacgacgtcaagcataccggtgttgttcgttgtgttagtgatgtaactaggggttctggtattacacatagagtaggtaaacggttttgtattaagtcaatctatattttagggaagatttggatggatgaaaatataaaaaaacaaaatcatactaaccaggtcatattctttttagtacgagaccgaaggccgtatggaactagtcctatggattttggtcaagtttttaacatgtttgataatgaacctagtacggctactgtgaagaacgatttaagggataggtaccaagtaatgaggaagttccatgccacggtggtaggtggtccgtcagggatgaaggagcagtgtctgttgaagaggttttttaaagttaatacccatgtagtttataatcatcaagagcaggcgaagtatgaaaaccatactgagaatgcgttgttgttgtatatggcatgtactcatgcttctaacccagtgtatgctacgttgaaaatacgtatctatttttatgatgctgtaacaaattaataaagattgtattttatttcatgttgttcaattacatttattgtgttttcaagtacatcatacaatacatgatcaactgctctgattacattgttaattgaaattacaccaatactatctaaatacttaagaacttgatgtctaaatactcttaagaaacgaccagtctgaggctgtaatgtcgtccagatgcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctatacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccatgcatcattactgtatacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatctttcggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacatctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggttttttaactgggaaagtgcttcttctttcgttaaggagcacttaggatatgtgaggaaataatttttgcaatttatttggaagcgcttagggggagccatatggtcaatgagtaccgattgaccaagatttttacacttatccctggtgtatcggtactcaatatatagtgagtaccaaatggcatattggtaattttgtaaaagtacaatgcaattcaaaattcaaaattcaaaaatcaaatcattaaagcggccatccgta

SEQ ID NO: 187 - DNA, 2771 bp, Tomato yellow leaf curl virus
accggatggccgcgccttttccttttatgtggtccccacgagggttccacagacgtcactgtcaaccaatcaaattgcatcctcaaacgttagataagtgttcatttgtctttatatacttggtccccaagtattttgtcttgcattatgtgggacccacttctaaatgagtttcctgaatctgttcacggatttcgctgtatgttagctatcaaatatttgcagtccgttgaagaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtatcgaaagcccagaatatacagaatgtatcgaagccctgatgttccccgtggatgtgaaggatcatgtaaagtccagtcgtacgagcagcggcatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgtttttcttggtccgagatagaaggccctatggaagcagcccaatggattttggacaggtttttaacatgttcgataatgagcccagtaccgcaaccgtgaagaatgatttgcgggataggtttcaagtgattaggaaatttcatgccacagttattggtgggccctctggaatgaaagaacaggcattagttaagagattttttagaattaacagtcatgtaacttataatcatcaggaggcagccaagtatgagaaccatactgaaaacgccttgttattgtatatggcatgtacgcatgcctctaatccagtgtatgcaactatgaaaatacgcatatatttctatgattcaatatcaaattaataaaatttatattttatatcatgactctctgttacatttattgtgtttgcaagtacatcatacaatacatgatcaactgctctgattacattgttaatggaaattacaccaagattatctaaatatctaagaactgcatatttaaatactcttaagaaacgaccagtctgaggctgtaatgtcgtccaaattcggaagttgagaaaacatttgtgaatccccattaccttcctgatattgtggttgaatcttatctgaatggaaatgatgtcgtggttcattagaaatggcctctggctgtgttctgttatcttgaaataaaggggattgtttatctcccagataaaaacgccattctctgcttgaggagcagtgatgagttcccctgtgcgtgaatccatgattattgcagttgaggtggaggtagtatgagcatccacagtctaggtctacacgcttacgccttattggtttcttcttggctatcttgtgttggaccttgattgatacttgcgaacagtggcttgtagagggtgacgaaggttgcattcttgagagcccaatttttcaaggatatgtttttctcttcgtctagatattccctatatgaggaggtaggtcctggattgcagaggaagatagtgggaattccccctttaatttgaatgggcttcccgtactttgtgttgctttgccagtctctctgggcccccatgaattctttaaagtgctttaaataatgcgggtctacgtcatcaatgacgttgtaccacgcatcattactgtacacctttggactcaggtctagatgtccacataaataattatgtgggcctagcgacctggcccacattgttttgcctgttctgctatcaccctcgatgataatactattaggcctccatggccgcgcagcggaagacacgacgttctcggccgcccatacttcaagttcttctggaacttgattaaaagatgaagataaaaagggagaaacataaggagccggaggctcctgaaaaattctatctaaattattatttaaattatgaaattggagtataaagtctcttggggctttctccttcagtatattgagggcctgagctttggaccctgaattgattgcctcggcatatgcgtcgttggcagattggcaacctcctctagctgatcgtccatcgacctggaaaactccatgatcaaggatgtctccgtctttttccatataggttttgacatcgcttgaactcttagctccctgaatgttcggatggaaatgtgctgacctggttggggatgtgaggtcgaagaatctgttgtttttgcactggaactttccttcgaactggatgagcacatgcaagtgaggagtcccatcttcatgaagctctctgcagattctaatgaattttttggaagtgggtgtttgtatatttaataattgggaaagtgcctcttctttagttagagagcatttgggataagtgagaaaataattttttgcatttattttaaaccgattgggggctgccatattgacttggtcaatcggtgtctctcaatttgctctatgtatcggtgtattggagtcctatatatatggagactccaatggcatatatgtaaatattgtactttaattcaaaatcctcacgctccaaaaagcggccatccgtataatatt

SEQ ID NO: 188 - DNA, 2781 bp, Tomato yellow leaf curl virus
taatattaccggatggccgcgccttttcctgttatgtggtccccacgagggttacacagacgtcactgtcaaccaatcaaattgcatcctcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcaaccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcagcgggatgatattaagcacactggtattgttcgttgtgttagtgatgttactcgtggatctggaattactcacagagtcggtaagaggttctgtgttaaatcgatatattttttaggtaaagtctggatggatgaaaatattaagaagcagaatcacactaatcaggtcatgttctttttggtccgtgatagaaggccctatggaagcagtccaatggattttggacaggtttttaatatgttcgataatgagcccagtaccgcaactgtgaagaatgatttgcgtgataggtttcaagtgatgaggaaatttcatgctacagttattggtgggccctctggaatgaaggaacaggcattagttaagagattttttaaaattaacagtcatgtaacttataatcaccaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattataccaagactatctaaatacttaagaacttcatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctggctgtggtctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgttggcctagagacctggcccacattgttttgcctgttctgctatcaccctcaatgacaatacttatgggtctccatggccgcgcagcggaatacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttttcttttaatatattgagggcctcggatttactgcttgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgtttggatggaaatgtgctgacctgtttggggataccaggtcgaagaaccgttggttcttacattggtatttgccttcgaattggataagcacatggagatgtggttccccattctcgtggaattctctgcaaactttgatgtattttttatttgttggggtttctatgttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttacttatacctggacacctaatggctatttggtaatttcataaatggtcattgcaattcaaaattcaaaattcaaaaatcaaatcattaaagcggtcatccgta

SEQ ID NO: 189 - DNA, 2781 bp, Tomato yellow leaf curl virus
taatattaccggatggccgcgccttttccttttatgtggtccccacgagggttccacagacgtcactgtcaaccaatcaaattgcatactcaaacgttaaataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcacactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttctttttggtccgtgatagaaggccctatggaagcagcccaatggattttggacaggtttttaatatgttcgataatgagcccagtaccgcaaccgtgaagaatgatttgcgtgataggtttcaagtgatgagaaaatttcatgcaacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgtaactatgaaaatacgcatctatttctatgattcaatatcaaattaataaaatttatattttatatcatgagtttctgttacatttattgtgttttcaagtacatcatacaatacatgatcaactgctctgattacattgttaatggaaattacaccaagactatctaaatacttaagaacttcatatctaaatactcttaagaaatgaccagtctgaggctgtaatgtcgtccaaattcggaagttgagaaaacatttgtgaatccccattaccttcctgatgttgtggttgaatcttatctgaatggaaatgatgtcgtggttcattagaaatggccgctggctgtgttctgttatcttgaaatagaggggattgtttatctcccaaataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagcgcccaatttttcaaggatatatttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgacaatactattaggtctccatggccgcgcagcggaagacacgacgttctcagcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttattgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgatctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttatttatacctggacacctaatggctatttggtaatttcgtaaaagtacattgcaattcaaaattcaaaattcaaaaatcaaatcattaaagcggccatccgta

SEQ ID NO: 190 - DNA, 2790 bp, Tomato yellow leaf curl virus
taatattaccggatggccgcgccttttccttttatgtggtccccacgagggttccacagctgtcactgtcaaccaatcaaattgcatactcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgactaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcacactggtattgttcgttgtgttagtgatgttactcgtggatctggaattactcatagagtgggtaagaggttctgtgttaaatcgatatattttttaggtaaagtctggatggatgaaaatatcaagaagcagaatcacactaatcaggtcatgttctttttggtccgtgatagaaggccctatggaagcagcccaatggattttggacaggtttttaatatgttcgataatgagcccagtaccgcaaccgtgaagaatgatttgcgtgataggtttcaagtgatgagaaaatttcatgcaacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaatggaaattacaccaagactatctaaatacttaagaacttcatatctaaatactcttaagaaatgaccagtctgaggctgtaatgtcgtccaaattcggaagttgagaaaacatttgtgaatccccattaccttcctgatgttgtggttgaatcttatctgaatggaaatgatgtcgtggttcattagaaatggccgctggctgtgttctgttatcttgaaatagaggggattgtttatctcccaaataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacatgcgaacagtggctcgtagagggtgacgaaggttgcattcttgagcgcccaatttttcaaggatatatttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaggggagaaatataaggagccggaggctcctgaaaaattctatctaaattactatttaaattatgaaattgtaaaatataatctttcggcattaattctttaatgattctaagagcctctgacttactgcctgagttaagagctgcggcgtaagcgttattggctgattgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggtcttttaattgggaaagtgcttcttctttcgttaaggagcacttaggatatgtgaggaaataatttttgcaatttatttggaagcgcttagggggagccatatggtcaatgagtaccgattgaccaagatttttacacttatccctggtgtatcggtactcaatatatagtgagtaccaaatggcatattggtaattttgtaaaagtacattgcaattcaaattcaaaattcaaaaatcaaatcattaaagcggccatccgta

SEQ ID NO: 191 - DNA, 2781 bp, Tomato yellow leaf curl virus
gttgaaatgaatcggtgtccctcaaagctctatggcaatcggtgtatcggtgtcttacttatacctggacacctaatggctatttggtaatttcgtaaaagtacattgcaattcaaaattcaaaattcaaaaatcaaatcattaaagcggccatccgtataatattaccggatggccgcgcctttttcttttgtgtggtccccacgagggttacacagacgtcactgtcaaccaatcaaattgcatcctcaaacgttagataagtgttcatttgtctttatatacttggtccccaagtattttgtcttgcaatatgtgggaccctcttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgacccggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcacactggtgttgttcgttgtgttagtgatgttactcgtggatctggaattactcacagagtgggtaagaggttttgtgttaaatcgatatattttttaggtaaagtctggatggatgaaaatatcaagaagcagaatcacactaatcaggtcatgttcttcttggtccgtgatagaaggccttatggaagtagtccaatggattttggacaggtttttaatgtgttcgataatgagcccagtaccgcaaccgtgaagaatgatttgcgggataggtttcaagtgatgaggaaatttcatgctacagttattggtgggccctctggaatgaaggaacaggcattagttaagagattttttaaaattaacagtcatgtaacttataatcatcaggaggcagccaagtatgagaaccatactgaaaacgccttgttgttgtatatggcatgtacgcatgcctctaatccagtgtatgcaactatgaaaatacgcatttatttctatgattcaatatcaaattaataaaatttatattttatatcatgagtttctgttacatttattgtgttttcaattacatcatacaatacatgatcaattgctctgattacattgttaattgaaattacaccaagtctatctaaatacttaagaacttgatatctaaatactcttaagaaacgaccagtctgaggctgtaatgtcgtccaaattcggaagttgagaaaacatttgtgaatcccaataaccttcctgatgttgtggttgaatcttatctgaatggaaatgatgtcgtggttcattagaaatggccgctggctgtgttctgttatcttgaaatagaggggattgtttatctcccagataaaaacgccattctctgcctgaggagcagtgatgagttcccctgtgcgtgaatccatgattgttgcagttgatgtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatgttccctatatgaggagctaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctaaatgtccacataaataattatgtgggcctagagacctggcccacattgttttgcctgttctgctatcaccctcaatgacaatacttatgggtctccacggccgcgcagcggaagacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcat

SEQ ID NO: 192 - DNA, 2791 bp, Tomato yellow leaf curl virus
accggatggccgcgccttttccttttatatggtccccacgagggttccacagacgtcactgtcaaccaatcaaattgcatccttaaacgttagataagtgttcatttgtctttatatacttggtccccaagtagtttgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcataaacaagcgacgatcatggacgtacaggcccatgtaccggaagcccagaatatacagaatgtatcgaagccctgatgttccccgtggatgtgaaggcccatgtaaagttcagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaaccacactaatcaggtcatgttcttcttggtccgtgatagaaggccctatggaaacagcccaatggattttggacaggtgtttaatatgttcgataatgagcccagtaccgcaacagtgaagaatgatttgcgggataggtttcaagtgatgaggaaatttcatgctacggttattggtggtccctctggaatgaaggaacaggcattagttaagagattttttagaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaatgaaatttatattttatatcatgagtttctgttacatttattgtgttttcaagtacatcatacaatacatgatcaactgctctgattacattgttaattgaaattacaccaatcctatctaaatacttaagaacttgatgtctaaatactcttaagaaatgaccagtctgagtctgtaatgtcgtccaaattcggaagttgagaaaacatttgtgaatccccaataccttcctgatgttgtggttgaatcttatctgaatgaaaatgatgtcgtggttcattagaaatggcctctggctgtgttcttttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggagttaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccatgcatcattactgtacacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaatcctatctaaattactatttaaattatgaaattgtaaaatataatctttcggtattaattctttaatgattctaagagcctctgacttactgcctgagttaagagctgcggcgtaagcgtcattggctgactgctgacccccacgtgcagatcgtccgtcgatctgaaactcaccccagtcgacggtgtttccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggttttttaattgggaaagtgcttcttctttcgttaaggagcacttaggatatgtgaggaaataatttttgcaatttatttggaagcgcttaggaggagccatatggtcaatgagtaccgattgaccaagatttttacacttatccctggtgtatcggtactcaatatatagtgagtaccaaatggcattttggtaattatgtaaaagtacattgcaattcaaaattcaaaattcaaaaattaaatcattaaagcggtcatccgtataatatt

SEQ ID NO: 193 - DNA, 2781 bp, Tomato yellow leaf curl virus
accggatggccgcgccttttctttttatgtggtccccacgagggttccacagacgtcactgtcaaccaatcaaattgcatcctcaaacgttagataagtgttcatttgtctttatatacttggtccccaagtagtctatcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggttcgtgatagaaggccctatggaaacagcccaatggattttggacaggtttttaatatgttcgataatgagcccagtaccgcaactgtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtatgagaaccatactgaaaacgccttgttattgtatatggcatgtacgcatgcctctaatccagtgtatgcaactatgaaaatacgcatctatttctatgattcaatatcaaattaataaaatttatattttatatcatgagttgctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaatgccttcctgatgttgtggttgaatcttatctgaatggaaatgatgtcgttgttcattagaaatggcctctggctgtgttctgttatcttgaaatagaggggattgtttatctcccagataaaaacgccattctctgcttgaggagcagtgatgagttcccctgtgcgtgaatccatgattgttgcagttgatgtggaggtagtatgagcagccacagtctaggtctacacgcttacgccttattggtttgttcttggctatcttgtgttggaccttgattgatacttgcgaacagtggctcgtagagggtgacgaagattgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacacatcattactgtacacctttgggcttaggtctagatgtccacataaataattatgtgggcctagagacctggcccacattgttttgcctgttctgctatcaccctcaatgacaatacttatgggtctccatggccgcgcagcggaagatacgacgttctcggcgacccactcgtcaagttcatctggaacttgattaaaagaagaagaaagaaatggagaaacataaacttctaaaggaggactaaaaatcctatctaaatttgaacttaaattgtgaaattgtaaaatatagtcctttggggccttctcttttaatatattgagggcctcggatttactgcctgaattgagtgcctcggcatatgcgtcgttggcagattgctgacctcctctagctgatctgctatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacacctaatggctatttggtaattttgtaaaagtacattgcaattcaaaattcaaaattcaaaaatcaaatcaataaagcggccatccgtataatatt

SEQ ID NO: 194 - DNA, 2781 bp, Tomato yellow leaf curl virus
accggatggccgcgccttttccttttatgtggtccccacgagggttccacagacgtcactgtcaaccaatcaaattgcatactcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtttcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcacactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttctttttggtccgtgatagaaggccctatggaagcagcccaatggattttggacaggtttttaatatgttcgataatgagcccagtaccgcaaccgtgaagaatgatttgcgtgataggtttcaagtgatgagaaaatttcatgcaacagttattggtgggccctctggaatgaaggaacaggcattagttaagagattttttaaaattaacagtcatgtaacttataatcatcaggaggcagccaagtacgagaaccatactgaaaacgccttattattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaatggaaattacaccaagactatctacatacttaagaacttcatatctaaatactcttaagaaatgaccagtctgaggctgtaatgtcgtccaaattcggaagttgagaaaacatttgtgaatccccattaccttcctgatgttgtggttgaatcttatctgaatggaaatgatgtcgtggttcattagaaatggccgctggctgtgttctgttatcttgaaatagaggggattgtttatctcccaaataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagcgcccaatttttcaaggatatatttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcattattactgtacacctttgggcttaggtctagatgtccacataaataattatgtgggcctagagacctggcccacattgttttgcctgttctgctatcaccctcaattacaatacttatgggtctccatggccgcgcagcggaagacacgacgttctcagcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttattgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgatctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttatttatacctggacacctaatggctatttggtaatttcgtaaaagtacattgcaattcaaaatttaaaattcaaaaatctaatcattaaagcggccatccgtataatatt

SEQ ID NO: 195 - DNA, 2781 bp, Tomato yellow leaf curl virus
accggatggccgcgccttttctttttatgtggtccccacgagggttccacatacgtcactgtcaaccaatcaaattgcatcctcaaacgttagataagtgttcatttgtctttatatacttggtccccaagtagtctgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggttcgtgatagaaggccctatggaaacagcccaatggattttggacaggtttttaatatgttcgataatgagcccagtaccgcaactgtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtatgagaaccatactgaaaacgccttgttattgtatatggcatgtacgcatgcctctaatccagtgtatgcaactatgaaaatacgcatctatttctatgattcaatatcaaattaataaaatttatattttatatcatgagttgctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaatgccttcctgatgttgtggttgaatcttatctgaatggaaatgatgtcgttgttcattagaaatggcctctggctgtgttctgttatcttgaaatagaggggattgtttatctcccagataaaaacgccattctctgcttgaggagcagtgatgagttcccctgtgcgtgaatccatgattgttgcagttgatgtggaggtagtatgagcagccacagtctaggtctacacgcttacgccttattggtttcttcttggctatcttgtgttggaccttgattgatacttgcgaacagtggctcgtagagggtgacgaagattgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacacatcattactgtacacctttgggcttaggtctagatgtccacataaataattatgtgggcctagagacctggcccacattgttttgcctgttctgctatcaccctcaatgacaatacttatgggtctccatggccgcgcagcggaagatacgacgttctcggcgacccactcgtcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcctcggcatatgcgtcgttggcagattgctgacctcctctagctgatctgctatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgtttaaatgaattggtgtccctcaaagctctatggcaatcggtgtatcggtgtcttacttatacctggacacctaatggctatttggtaattttgtaaaagtacattgcaattcaacattcaaaattcaaaaatcaaatcaataaagcggccatccgtataatatt

SEQ ID NO: 196 - DNA, 2781 bp, Tomato yellow leaf curl virus
accggatggccgcgccttttctttttatgtggtccccacaagggttccacagacgtcactgtcaaccaatcaaattgcatcctcaaacgttagataagtgttcatttgtctttatatacttggtccccaagtagtctgtcttgcaatatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgcctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggttcgtgatagaaggccctatggaaacagcccaatggattttggacaggtttttaatatgttcgataatgagcccagtaccgcaactgtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagttgctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaatgccttcctgatgttgtggttgaatcttatctgaatggaaatgatgtcgttgttcattagaaatggcctctggctgtgttctgttatcttgaaatagaggggattgtttatctcccagataaaaacgccattctctgcttgaggagcagtgatgagttcccctgtgcgtgaatccatgattgttgcagttgatgtgtaggtagtatgagcagccacagtctaggtctacacgcttacgccttattggtttcttcttggctatcttgtgttggaccttgattgatacttgcgaacagtggctcgtagagggtgacgaagattgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacacatcattactgtacacctttgggcttaggtctagatgtccacataaataattatgtgggcctagagacctggcccacattgttttgcctgttctgctatcaccctcaatgacaatacttatgggtctccatggccgcgcagcggaagatacgacgttctcggcgacccactcgccaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcctcggcatatgcgtcgttggcagattgctgacctcctctagctgatctgctatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacacctaatggctatttggtaattttgtaaaagtacattgcaattcaaaattcaaaattcaaaaatcaaatcaataaagcggccatccgtataatatt

SEQ ID NO: 197 - DNA, 2781 bp, Tomato yellow leaf curl virus
accggatggccgcgccttttctttttatgtggtccccatgagggttccacagacgtcactgtcaactaatcaaattgcatcctcaaacgttagataagtgtttatttgtctttatatacttggtccccaagtagtttgtcttgcactatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattacccacagagtgggtaagaggttctgtgttaaatcgatatattttttaggtaaagtccggatggatgaaaatattaagaagcagaatcacactaatcaggtcatgttcttcttggttcgtgatagaaggccctatggaaacagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttagaattaacagtcacgtaacttataatcatcaggaggcagccaagtatgagaaccatactcaaaacgccttgttattgtatatggcatgtacgcatgcctctaatccagtgtatgcaactatgaaaatacgcatctatttctatgattcaatatcaaattaataaaatttatattttatatcatgagtttctgttacatgtattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcgtgaggagcagtgatgagttcccctgtgcgtgaatccatgattgttgcagttgatgtggaggtagtatgagcagccacagtctaggtctacacgcttacgccttatgggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttcggctatcaccctcaatgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcctcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagggcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacacctaatggctatttggtaattttgtaaaagtacaattcaattcaaaattcaaaattcaaaaatcaaatcattaaagcggccatccgtataatatt

SEQ ID NO: 198 - DNA, 2780 bp, Tomato yellow leaf curl virus
accggatggccgcgcccgaaaaaaaaaagtggcccccacgcacaattttatgttagccaatcaaattacatcatgaaacgttagataagtattcatttgtccttatatacttggtccccaagttgtttgtccagcaatatgtgggatccacttctaaatgaatttcctgaatctgttcatggatttcgttgtatgttagctattaaatatttgcaggccgttgaggaaacttacgagcccaatacattgggccacgatttaattagggatcttatatctgttgtaagggcacgtgactatgtcgaagcgaccaggcgatataatcatttccacgcccgtctcgaaggttcgccgaaggctgaacttcgacagcccatacagcaaccgtgctgctgtccccattgtcccaggcacaaacaagcgacggtcatggacatacaggcccatgtaccgaaagcccagaatatacagaatgtatcgaagtcctgatgttccccgtggatgtgaaggcccatgtaaggtccagtcttatgagcaacgggatgatattaagcatactggtattgttcgttgtgttagtgatgttactcgtggatccggaattacccacagagtggggaagaggttctgtgttaaatcgatatattttttaggtaaagtctggatggatgaaaatatcaagaagcagaatcacactaatcaggtcatgttcttctcggtccgtgatagaagaccctatggaaacagcccaatggattttgggcaggtttttaatatgttcgacaatgagcccagtaccgcaaccgtgaagaatgattacagggataggtttcaagtgatcaggaaatttcatgctactgtcattggtgggccttctggaatgaaggaacaggctttagttaagagattctttagaattaacagtcatgtaacttataatcatcaagaggctgccaagtacgagaatcatactgagaacgccttgttattgtatatggcatgtacgcatgcctctaatccagtgtatgcaactatgaaaatacgcatctatttctatgattcaatatcaaattaataaacattatattttatatcatggttctctgttacatctattgtcttttcaagtacattatataatacatgatcaactgctctaattacattgttaatagaaattacaccaagactatctaaatacttaagaacttgatatctaaatactcttaagaaacgaccagtctgaggccgtaaggttgtccaaattcggaagttgagaaaacatttgtgaatccccagaaccttcctgatgttgtggttgaatcttatctgaatggaaatgacgtcgtggttcattagaaatggcctctggctgtgttctgttatcttgaaatagaggggattgtttatctcccagataaaaacgccattctctgcttgaggagcagtgatgagttcccctgtgtgtgaatccatggttgttgcagttgagatggaggtagtatgagcagccacagtctaggtctacacgcttacgccttattggtttcttcttggctatcttgtgttggaccttgattggtacttgagaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtatttagtgttgctttgccagtccctttgggcccccatgaattccttgaagtgctttaaataatgcgggtctacgtcatcaatgacgttgtaccacgcatcattactgtacacctttggacttaggtctagatgtccacataaatagttatgtgggcctagagacctagcccacattgttttgcctgttctgctatcaccctcgatgataatactattaggtctccatggccgcgcggcggaagacatgacgttctcggacacccatacttcaagttcctctggaacttgattaaaagaagaagataaaaaaggagaactataaggagccggaggctcctgaaaaattctatctaaattactatttaaattatgaaactgtaaaatataatctctgggggctaattccctaagtactctaagagcctctgccttacttccagagttaattgctgcggcgtaagcgtcgtttgcagattgttgtccccctcttgcagaccttccatcgatctgaaactgtccccagtcgagggtgtcgccctccttctcgatgtaagacttgacgtcggaactggatttagctccctgaatgtttggatggaaatgtgctgccctgcttggggataccaggtcgaagaatcgctgattttggcacttgaatttcccctcgaattggataagcacatgaagatgtggttccccattctcgtggagttctctgcaaactttgatgtattttttatttgttggggtttctaggttttgtaattgggaaagtgcctcttctcttgttaaggagcactgaggatatgtgaggaaataatttttgcaatttatttggaaacgcttagggggagccatatggtcaatgagtaccgattgaccaagatttgcacttatcccttgtatatcggtactcaatatatagtgagtaccaaatggcactttggtaatttggtaaaagcatattgcaattcaaaattcaaatttgaaaaatcaaatcattaaagcggccatccgtataatatt

SEQ ID NO: 199 - DNA, 2781 bp, Tomato yellow leaf curl virus
accggatggccgcgccttttccttttatatggtccccacgaggattacacagacgtcactgtcaaccaatcaaattgcatcatcaaacgttatataagggttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagagcccgtgactatgttgaagcgaccaggcgatataatcatttccacgcccgtctcgaaggttcgccgaaggctgaacttcgacagcccatacagcaaccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcagcgggatgatattaagcacactggtgttgttcgttgtgttagtgatgttactcgtggatctggaattactcatagagtcggtaaaaggttctgtgttaaatcgatatattttttaggtaaagtctggatggatgaaaatatcaagaagcagaatcacactaatcaggtcatgttctttttggtccgtgatagaaggccctatggaagcagtccaatggattttggacaggtttttaatatgttcgataatgagcccagtaccgcaactgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggctgccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattacaccaagactatctaaatacttaagaacttcatatctaaatactcttaagaaatgaccagtctgaggctgtaatgtcgtccaaattcggaagttgagaaaacatttgtgaatccccattaccttcctgatgttgtggttgaatcttatctgaatggaaatgatgtcgtggttcattagaaatggcctttggctgtggtctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctattaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttttcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttaacatctgttgagctcttagctgcctgaatgtttggatggaaatgtgctgacctgtttggggataccaggtcgaagaatcgttggttcttacattggtatttgccttcgaattggataagcacatggagatgtggttccccattctcgtggaattctctgcaaactttgatgtattttttatttgttggggtttctatattttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttacttatacctggatacctaatggctatttggtaatttcataaatgttcattgcaattcaaaattcaaaattcaaaaatcaaatcattaaagcggtcatccgtataatatt

SEQ ID NO: 200 - DNA, 2772 bp, Tomato yellow leaf curl virus
accggatggccgcgctccccgataaagtagtgggccctacgcagtaatttgtgtcgaccaatgaaaatgcagcctcaaagcttaaataatgtatttactttgttataaacttggcttctaagttttgaaaaaaccatcaatatgtgggatcctttattaaatgaatttccagattcagttcatggtctccgttgtatgcttgcaataaaatatttgcagctagttgaagaaacctatgaacccaatactctgggtcacgatctaattagggatctcatttccgtcattcgtgctcgtgactatgccgaagcgaacaggcgatatactaatttcaacgcccgtctcgaaggttcgtcgaaaactgaacttcgacagcccgtataccagccgtgctgctgcccccactgtccaaggcatcaagcgtcgatcatggacttacaggcccatgtatcgaaagccgcggatgtacagaatgtacagaagccctgatgtcccctttggttgtgaaggtccttgtaaagtccagtcgtatgagcagcgtgacgacgtaaagcataccggtgttgttcgttgtgttagtgatgtaactaggggttctggtattacacatagagtaggtaaacggttttgtattaagtcaatctatattttagggaagatttggatggatgaaaatataaaaaaacaaaatcatactaaccaggtcatgttctttttagtacgagaccgaaggccgtatggaactagtcctatggattttggtcaagtttttaacatgtttgataatgaacctagtacggctactgtgaagaacgatttaagggataggtaccaagtaatgaggaagttccatgccacggtggtaggtggtccgtcagggatgaaggagcagtgtctgttgaagaggttttttaaagttaatacccatgtagtttataatcatcaagagcaggcgaagtatgaaaaccatactgagaatgcgttgttgttgtatatggcatgtactcatgcttctaacccagtgtatgctacgttgaaaatacgtatctatttttatgatgctgtaacaaattaataaatattgtattttatttcatgttgttcaattacatctattgtgttctcaaatacatcgaataagacataatcaactgctctaataacattgtttaatgaaattacacctatattattcaaatacttgtacacttgaaacctaaagactcttaaaaaatgaccagtcggagactgtaaggtcgtccagatgcggaagttgagaaaacatttgtgaatccccagtgccttcctcaagttgttgttgaacctgatttgaaatgttagtaaattgtatttgctgttgaatggttgttggttgtgtctggttatcgtgaaatataggggatttgttatctcgaaggtataaacgccactcgttgcttgatgcgcagtgatgtactcccctgtgcgtaaatccatggtttatgcagtctaaatgtatatagtatgaacagccacagtccagatctacccttctacgcctcacttgtctcttcttggcgatgtggtgttggatcttgattggtatttgtgaacaatggctggtggatggtgacgaagattgcattttttatggcccaattttttaaggcttgatttttttcttcgtcgaggtattctttaaatgatgattgtgggcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaattacaatacttatgggtctccatggccgcgcagcggaagacacgacgttctcagcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttattgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgatctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttatttatacctggacacctaatggttatttggtaatttcgtaaaagtacattgtaattcaaaattcaaaattcaaaaatcaaatcattaaagcggccatccgtataatatt

SEQ ID NO: 201 - DNA, 2794 bp, Tomato yellow leaf curl virus
accggatggccgcgcccttcctttttgtggtcccccttgggtcctatagacgtcactatcaaccaatcaaattgcatccttaaacgttagataagtgtttatttgtctttatatacttggtctccaagtttttttgtcatgtaatatgtgggatccactcctaaatgaatttcctgaatctgttcacggatttcgttgtatgttagctattaaatatttgcaggccgttgaagaaacgtatgagcccaatactttgggccacgatttaattagggatcttatatctgttgtaagggcccgtgactatgtcgaagcgacccggcgatataatcatttccacgcccgtctcgaaggttcgccgaaggctgaacttcgacagcccatacagcagccgtgctgctgcccccattgtccaaggcataaacaagcgacggtcatggacgtacaggcccatgtaccgaaagcccagaatatacagaatgtatcgaagccctgatgttccccgtggatgtgaaggcccatgtaaggtccaatcttatgagcaacgggatgacattaagcatactggtgttgttcgttgtgttagtgatgttactcgtggttccggtattacccacagagtgggtaagaggttttgtgttaagtccatatattttttaggtaaggtctggatggacgaaaatatcaaaaagcagaaccatactaatcaagtcatgttcttcttggtccgtgataggaggccctatggaaacagcccaatggattttggacaggtttttaatatgttcgacaatgagccgagtaccgcaaccgtgaagaatgatctcagggataggtttcaagtgatgaggaaatttcatgctaccgttattggtggtccttctggtatgaaggaacaggctttagttaagagattctttaaaattaacagtcatgtaacttataatcatcaggaggcagctaagtacgagaatcatactgaaaacgccttgttattgtatatggcatgtacgcatgcctctaatccagtgtatgcaactatgaaaatacgcatctatttctatgattcaatatcaaattaataaaaattatattttatatcatgggtttctgttacatctattgtctgttcaagtacatcatataatacatgatcaactgctctaattacattattaatggaaattacacctacattatttaaatatttaagaatttgatatctaaatactcttaagaaacgaccagtctgaggccgtaaggtcgtccagattctgaagttgagaaaacatttgtgaatccccagtaccttcctgatgttgtgattgaatcggatctgtattgaaatgatgtcgtgatccatgttgaatggcctctggttgtggtctgttatcttgaaataaaggggattgtttatctcccagataaaaacgccattctctgcttgaggagcagtgatgagttcccctgtgcgtaaatccatggttgatgcagttgatgtgtagatagtatgagcagccacagtctaggtctacacgcttacgcctgattggtttcttcttggctatcttgtgttgcactttgattggtacttgagaacaatggcttgtagagggtgatgaaggttgcattcttgagagcccaatttttcaatgacaggtttttttcttcatctagatattctctatatgatgaagtaggtccttgattgcagaggaagatagtgggaattccacctttaatttgaatgggtttcccgtattttgtgttactctgccagtccctttgggcccccatgaattctttaaagtgctttaaataatgcgggtctacgtcatcaatgacgttataccacgcatcatttgaaaatatcttagggctgagatcgagatgtccacacaaataattgtgtggacctaacgatcgtgcccacattgtttttccggtacgactatcaccctcgattacaatactatcaggtctccatggccgcgcagcggaagacatgacgttctcggacacccatacttcaagttcctctggaacttgattaaacgaagaagacaaaaaaggagaaatataaggagctggaggctcctgaaaaattctatctaaattactatttaaattatgaaattgtaaaacataatctttgggggctagttccttaatgactctaagagcttccgacttacttcctgagttaagagctgctgcgtaagcatcgtttgctgattgttgtcccccccttgcagaccttccatcgatctgaaactctccccaatcgatggtgtctccatccttgtcgatgtaggacttgacatcagatgatgatttagctccctgaatgtttggatggaaatgtgttgatctacttggggataccaggtcgaagaatctgttatttgtgcactggtattttcctttgaactgaacaagggcatgcagatgaggttccccattttcgtgaagctctctgcaaattttaatgtataatttatttacaggtgtttctagggtttgtagttgggaaagggcttcagttaatgaaagagaacactggggataagtaaggaaataatttttggcatttattttaaaacgctttgggggagccatttggtcaatgtaccccgattgacttggatttcatttggcacctgtaaacggtgtaatggggtacaatatatacttgtactccaaatggcaatttagtaattttgtaaaagtatattgcaattttaaattcaaaattcgaaaatcaaatcattaaagcggccatccgtataatatt

SEQ ID NO: 202 - DNA, 2781 bp, Tomato yellow leaf curl virus
accggatggccgcgccttttccttttatgtggtccccacgagggttacacagacgtcactgtcaaccaatcaaattgcatcctcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcaaccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcagcgggatgatattaagcacactggtgttgttcgttgtgttagtgatgttactcgtggatctggaattactcacagagtcggtaagaggttctgtgttaaatcgatatattttttaggtaaagtctggatggatgaaaatatcaagaagcagaatcacactaatcaggtcatgttctttttggtccgtgatagaaggccctatggaagcagtccaatggattttggacaggtttttaatatgttcgataatgagcccagtaccgcaactgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattacaccaagactatctaaatacttaagaacttcatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctggctgtggtctgttatcttgaaatagaggggattgtttatctcccaaataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatcctatctaaatttgaatttaaattatgaaattgtaaaatatagtcctttggggccttttcttttaatatattgagggcctcggatttactgcctgaattgagtgctccggcgtatgcgtcgttggcagattgctgacctcctctagctgatctgccatcgatttggaaaactccaaaatcaatgaagtctccgtctttctccacgtaggtcttgacatctgttgagctcttagctgcctgaatgtttggatggaaatgtgctgacctgtttggggataccaggtcgaagaaccgttggttcttacattggtatttgccttcgaattggataagcacatggagatgtggttccccattctcgtggaattctctgcaaactttgatgtattttttatttgttggggtttctatgttttttaattgggaaagtgcttcctctttagagagagaacaattgggatatgttaggaaataattcttggcatatattttaaataaacgaggcatgttgaaatgaatcggtgtccctcaaagctctatggcaatcggtgtatcggtgtcttactaatacctcgacacctaatggcaatttggtaatttcataaatgttcattgcaattcaaaattcaaaattcaaaaatcaaatcattaaagcggtcatccgtataatatt

SEQ ID NO: 203 - DNA, 2781 bp, Tomato yellow leaf curl virus
accggatggccgcgccttttccttttatgtggtccccacgagggttacacagacgtcactgtcaaccaatcaaattgcatcctcaaacgttagataagtgtgcatttgtctttatatacttggtccccaagttttttgtcttgcaatatgtgggacccacttcttaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaagcagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattacaccaagactatctaaatacttaagaactccatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctgactgtgttctgttatcttgaaatagaggggattgtttatctcccagataaaaacgccattctctgcctgaggagcagtgatgagttcccctgtgcgtgaatccatgattattgcagttgaggtggaggtagtatgagcatccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattcctttaagtgttttaaataatgcgggtctacgtcatcaatgacgttataccacgcatcattactgtacacctttgggcttaggtctagatgtccacataaataattatgtgggcctagagacctggcccacattgttttgcctgttctgctatcaccctcaatgacaatacttatgggtctccatggccgcgcagcggaatacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatatactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtattttccttcgaattggataagcacatggagatgtggttccccattctcgtggagttctctgcaaactttgatgtattttttatttgttggggtttctatgttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttacttatacctggacacctaatggctatttggtaatttcataaatgttcattgcaattcaaaattcaaaattcaaaaatcaaatcattaaagcggccatccgtataatatt

SEQ ID NO: 204 - DNA, 2459 bp, Tomato yellow leaf curl virus
acgcccgtctcgaaggttggccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtacagtcttatgagcaacgggatgatattaagcacactggtattgttcgttgtgttagtgatgttactcgtggatctggaattactcacagagttggtaagaggttctgtgttaagtcgatatattttttaggtaaagtctggatggatgaaaatatcaagaagcagaatcacactaatcaggtcatgttcttcttggtccgtgatagaaggccctatggaagcagcccaatggattttggacaggtttttaatatgttcgataatgagcccagtaccgcaaccgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtatgagaaccatactgaaaacgccttgtattgtatatggcatgtacgcatgcctctaatccagtgtatgcaactatgaaaatacgcatctatttctacgattcaactatcaaattaataaaatttatattttatatcatgagtttctgtctacatttattgtgttttcaagtacatcatacgaactacgatgatcaactgctctgattacattgttaattgaaattccacctaaccattgatctaaatacttaagaacttgatatctaaatactcttaagaaacgcaccagtctgaggctgtaatgtcgtccaaattcggaagttgagaaaacatttgtgaatccccaataccttcctgatgttgtggttgaatcttatctggatggaatgatgtcgtggttcattacaaatggcctctggctgtgttctgttatcttgaaatagaggggattgtttatctgccagataaaaacgccattctctgcttgaggagcggtgatgagttcccctgtgcgtgaatccatgattgttgcagttgatgtggaggtactatgagcagccacagtctacgtctacacgcttacgccttattggtttcttcttggctatcttgtgttggaccttgattgatacttgcggaacagtggctcgtagagggtgacgaaggttgcattcttgagagcccaatttttcaaggatatgttttttcttcgtctagatattcccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccatgcatcattactgtatacctttgggcttaggtctagatgtccacataaataattatgtgggcctagagacctggcccacattgttttgcctgttctgctatcaccctcaatgacaatactattaggtctccatggccgcgcagcggaagacacgacgttctcggacacccatacttcaagttcatctggaacttgattaaaagatgaagataaaaagggagaaatataaggagccggaggctcctgaaaaattctatctaaattactatttaaattatgaaattgtaaaatataatctttcggtattaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcacttgaatttcccttcaaattggataagcacatggagatgtggttccccattctcgtggagttctctgcaaactttgatgtattttttatttgttggggtttctaggttttttaactgggaaagtgcttcttctttcgttaaggagcatttaggatatgtgaggaaataatttttgcaatttatttggaagcgcttagggggagccatatggccaatgagtaccgattgaccaagatttttacacttatccctggtgtatcggtactcaatatatagtgagtaccaaatggcattttggtaattttataaaagtacattgcaattcaaaattcaaaattcaaaaatcaaatcattaaagcggccatccgtataatatt

SEQ ID NO: 205 - DNA, 2781 bp, Tomato yellow leaf curl virus
taatattaccggatggccgcgcattttccttttatgtggtccccacgagggttatacagacgtcactgtcaaccaatcaaattgcatcctcaaacgttagataagtgttcatttgtctttatatacttggtccccaagtattttgtcttgcaatatgtgggaccctcttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgacccggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtgcagtcttatgagcaacgggatgatattaagcataccggtattgttcgttgtgtcagtgatgttactcgtggatctggaattactcacagagtgggtaagaggttctgtgttaaatcgatatattttttaggtaaagtctggatggatgaaaacatcaagaagcagaatcacactaatcaggtcatgttcttcttggtccgtgataggaggccctatggaaacaacccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttaaaattaacagtcatgtaacttataatcatcaggaggcagccaagtatgagaaccatactgaaaacgccttgttattgtatatggcatgtacgcatgcctctaatcctgtgtatgcaactatgaaaatacgcatctatttctatgattcaatatcaaattaataacatttatattttatatcatgagcttctgttacatttattgtgttttcaagtacatcatacaatacatgatcaactgctctgattacattgttaatggaaattacaccaagactatctaaatacttaagaacttcatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggccgctggctgtgttctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggttcgtagagggtgacgaaggttgcattcttgagagcccaatttttcaaggatatgtttttttcttcatctagatattccctatatgaggaggtaggtcctggattgcagagaaagatagtgggaattccccctttaatttgaatgggcttcccgtactttgtgttgctttgccagtccctctgggcccccatgaattccttgaagtgctttaaataatgcgggtctacgtcatcaatgacgttgtaccacacatcgttattgtacacctttgggcttaggtctagatgtccacataaataattatgtgggcctagagacctggcccacattgtcttgcccgttctgctatcaccctcaatgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgttgacctcctctagctgatctgccatcgatttggaaaactccaaaatcaatgaattctccgtctttctccacgtaggtcttgacatctgttgagctcttagctgcctgaatgttcggatggaaatgtgctgacctgtttggggataccaggtcgaagaaccgttggtttttacattggtatttgccttcgaattggataagcacatggagatgtggttccccattctcgtggaattctctgcaaactttgatgtattttttatttgttggggtttctaggttttttaattgggaaagtgcttcctctttagagagataacaattgggatatgtcaggaaataatttttggcatatattttaaataaacgaggcatgttgaaatgaatcggtgtccctcaaagctctatggcaatcggtgtattggtgtcttacttatacctggacacctaatggctatatggtaatttcataaatgtttattgcaattcaaaattcaaacttcaaaaatcaaatcattaaagcggccatccgta

SEQ ID NO: 206 - DNA, 2785 bp, Tomato yellow leaf curl virus
accggatggccgcgccctttctttttttgttgtccccacgtgggtcccacacacgtcgctatcaaccaatcaaattgcagcctcaaacgttagataattgttcatttgtctttatatacttggtccccaagttttatttcctgcaatatgtgggacccacttctcaatgaatttcctgaatccgttcacggatttcgttgtatgttagctattaaatatttgcaggccgttgaggaaacgtacgagcccaacaccttgggccacgatttaattagggatcttatatctgttgtaagggctcgtgactatgtcgaagcgacccggcgatataatcatttccacgcccgtctcgaaggttcgccgaaggctgaacttcgacagcccatacagcagccgtgctgctgcccccattgtccaaggcacaaacaggcgccgatcatggacgtacaggcccatgtaccgaaagcccagaatatacagaatgtatcgaagccctgatgttcctcgtggatgtgaaggtccatgtaaggtccagtcttatgagcaacgggatgatattaagcatactggcattgttcgttgtgtgagtgatattactcgtggaactggtattacccacagagtgggtaagaggttttgtgttaagtccatatatttcttaggtaaggtctggatggatgataacatcaagaagcagaaccacaccaatcaggtcatgttcttcttggttcgtgatagaaggccctatggaaatagcccaatggattttggacaggtttttaatatgtttgataatgagcccagtaccgcaaccgtgaagaatgattttagggataggtttcaagtgattaggaaatttcatgctactgttattggtggtccttctggaatgaaggaacaggctttagttaagagattttttaggatcaattgtcatgtaacgtataatcatcaggaggcagccaagtatgagaatcatactgaaaacgccttgttgttgtatatggcatgtacgcatgcctctaatccagtgtacgcaactatgaaaatacgcatctatttctatgattcaatatcaaattaataaaatttatattttatttcatgattctccgtaacttggagtgtgtttacaaatacatcatacaatacatgatcagctgctctaattacattgttaagtgaaattactcctaagttatctaaatatttaagtacttgatatctaaatactcttaagaaacgaccagtctgaggccgtaaggtcgtccaaattcggaagttgagaaaacatttgtgaatccccagtaccttcctgatgttgtgattgaatcttatctgcattgaaatgatgtcgttgttcgtgttgaatggccgctcgtcgtggttggttattttgaaatagaggggattgtttatctcccagataaaaacgccattctctgcttgaagagcagtgatgagttcccctgtgcgtaaatccatggtcgatgcagttgatatcgagatagtatgtgcagccacagtctaggtcgacacgcctacgcctgattggtttcttcttggctatcttgtgctggaccttgattggtacttgagaacagtggctcgtagagggtgatgaaggttgcattcttgaaagcccaatttttcaaagatatgtttttttcctcgtctagatattctctatatgaggaggtaggtcctggattgcagaggaagatagtgggaattccccctttaatttgaatgggcttcccgtactttgtgttgctttgccagtccctctgggcccccatgaattctttaaagtgctttaaataatgcgggtctacgtcatcaatgacgttgtaccacgcatcattactgtacacctttgggcttaggtccaaatgtccacataaataattatgtggtcctagagacctggcccacatcgtcttgccggtccgactatcaccctcgatgacaatactattaggtctccatggccgcgcagcggaaggcatggcgttctcggacacccagacttcaagttcttcaggaacttgattaaaagaagaagataaaaaaggagaaatatagggagccagaggctcctgaaaaatcctatctaaattactatttaaattatgaaattgtaaaatatagtctttgggggctagttccctaatgactctaagagcctctgacttactgcctgagttaagtgctgcggcgtaagcgtcgttggctgattgctgaccccctcttgcagatcgtccgtcgatctgaaactcgccccagtcgatggtgtctccatctttatcgatgtaggatttgacatcagatgaggatttagctccctgaatgtttggatggaaatgtgatgatctggttggggataccaggtcgaagaatctgttattcgtgcactggtacttgccttcgaactgaacaagggcatgcagatgaggttccccattttcgtgaaactctctgcaaattttaatgtataatttttttacaggagtttcgagggtttgtagttgggaaagtgcttcagatattgaaagagaacactggggataagtaaggaaataatttttggcatttattttaaaacgctttgggggagccatttggtcaatgtaccccgattgacttggatttcatttggcacctgcaatcggtgtaatggggtacaatatatacttgtacccctaatggcaatttggtaataactccatacctttaatttaaaattcaaaaatcaaatcattaaagcggccatccgtctaatatt

SEQ ID NO: 207 - DNA, 2781 bp, Tomato yellow leaf curl virus
accggatggccgcgccttttctttttatgtggtccccacgagggttccacagacgtcactgtcaaccaatcaaattgcatcctcaaacgttagataagtgttcatttgtctttatatacttggtccccaagtagtttgtcttgcattatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatattaagaagcagaatcacactaatcaggtcatgttcttcttggttcgtgatagaaggccttatggaaacagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtatgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattaaaaatggcctctggctgtgttctgttatcttgaaatagaggggattgtttatctcccagataaaaacgccattctctgcttgaggagcagtgatgagttcccctgtgcgtgaatccatgattgttgcagttgatgtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctaaatgtccacataaataattatgtgggcctagagacctggcccacattgttttgcctgttctgctatcaccctcaatgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcctcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacaccaaattgctatttggtaattttgtaaaagtacattgcaattcaaaattcaaaattcaaaaatcaaatcattaaagcggccatccgtataatatt

SEQ ID NO: 208 - DNA, 2765 bp, Tomato yellow leaf curl virus
accggatggccgcgcgccccacgtgggtcccacacacgtcgctatcatccaatcaaattgatgactgaaacgttagataattgtttatttgtctttataaacttagtccccaagtttgttgtcttgcaatatgtgggatccacttcttaatgaatttcctgaatccgttcacggatttcgttgtatgttagctattaaatatttgcaggccgttgaggaaacgtatgagcccaacactttgggccacgatttaattagggatcttatatctgttgtaagggctcgtgactatgtcgaagcgacccggcgatataatcatttccacgcccgtctcgaaggttcgccgaaggctgaacttcgacagcccctacagcagccgtgctgctgcccccattgtccaaggcataaacaagcgccgatcatggacgtacaggcccatgtaccgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgtggatccggaattacccacagagtgggtaagaggttctgtgttaaatccatatattttttaggtaaagtttggatggatgaaaatatcaagaagcagaatcacactaatcaggtcatgttcttcttggtccgtgatagaaggccctatggaaacagcccaatggattttgggcaggtttttaatatgttcgataatgagcctagtaccgcaaccgtgaagaatgatctccgggataggtttcaagtgatgaggaaatttcatgctacagttattggtgggccctctggaatgaaggaacaggcattagttaagagattttttagaattaacagtcatgtaacttataatcatcaggaggcagccaagtatgagaatcatactgagaatgctttgttgttgtatatggcatgtactcatgcctctaatccagtgtatgcaactatgaaaatacgcatctatttctatgattcaatatcaaattaataaaatttatattttatatcatgactttcggttacatttattgtgttttcaagtacatcatataatacatgatcaactgctctgattacattgttaatggaaattacaccaagattatctaaatacttaagaacttgatatctaaatactcttaagaaacgaccagtctgaggctgtaatgtcgtccaaattcggaagttgagaaaacatttgtgaatccccagtaccttcctgatgttgtgattgaatcttatctgtattgaaatgatgtcgtggctcattagaaatggcctctcgtcgtggttggtgatcttgaaatacaggggattttcgatctcccatataaaaacgccattctgggcttgatgagcagtgatgagttcccctgtgcgtgaatccatgattgatgcagttgatgtggaggtaatatgagcatccgcagtcgaggtctatgcgctttcgtctgactggcttagtcttcgctatgcggtgttggattttgattggcacttgagaacagtggctcgtagagggtgacgaaggttgcattcttgagagcccaattttttaaggatatgtttttttcttcgtctagatattccctatatgaggaggtaggtcctggattgcagagaaagatagtgggaattccccctttaatttgaatgggtttcccgtattttgtgttgctttgccagtccctctgggcccccattaattccttgaagtgctttaaataatgcgggtttacgtcatcaatgacgttaaaccacgcatcattactgtatacctttggacttaggtctagatgtccacataaataattatgtgggcctagagacctggcccacattgttttgcctgttctgctatcaccctcgatgacaatactattaggtctccatggccgcgcagcggaagacatgacgttctccgacacccatacttctagttcctctggaacttgattaaaagatgaagataaaaagggagaaatataaggagccggaggctcctgaaaatacctatctaaattactatttaaattatgaaattggagtagaaagtctcttggggctttctccttcagtatattgagggcctgagctttggaccctgcgttgattgcctcggcatatgcgtcgttggcagattggcaacctcctctagctgatcttccatcgacctggaaaactccatgatcaaggatgtctccgtctttctccatgtaggttttgacatcgcttgagcttttagctccctgaatgttcggatggaaatgtgctgacctggttggggaggtgaggtcgaagaatctattgttcttgcactggaactttccttcgaattggatgagaacatgcaagtgaggagtcccatcttcgtgaagctctctgcagattctaatgaattttttggaagtgggtgtttggagatttaataattgggaaagtgcttcctttttagtaagagagcacttgggatatgtgagaaaataatttttggcatttattttaaaccgattgggggctgccatgctgacttagtcaatcggtgtctcgcaatttgctctatgtatcggtgtactggagtcctatatatatggagactccaatggcataattgtaatttcgtaaaagcatttttaaaagtaaaattcaaaaatcaaaatcctaaagcggccatccatataatatt

SEQ ID NO: 209 - DNA, 2781 bp, Tomato yellow leaf curl virus
accggatggccgcgccttttccttttgtgtggtccccacgagggttacatagatgtcactgtcaaccaatcaaattccatcctcaaacgttagataagtgttcatttgtctttatatacttggtccccaagtattttgtcttgcaatatgtgggaccctcttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgacccggcgatataatcatttccacgcccgtctcgaaggttcgccgaaggctgaacttcgacagcccatacagcaaccgtgctgctgtccccattgtccaaggcacaaacaagcgacgatcatggacgtacaggcccatgtaccgaaaacccagaatatacagaatgtatcgaagccctgatgttccccgtggatgtgaaggcccatgtaaagtccagtcttatgagcagcgggatgatattaaacacactggtgttgttcgttgtgttagtgatgttactcgtggatctggaattactcacagagtcggtaagaggttctgtgttaaatcgatatattttttaggtaaagtctggatggatgaaaatatcaagaagcagaatcacactaatcaggtcatgttcttcttggtccgtgatagaaggccctatggaagcagtccaatggattttggacaggtttttaatatgttcgataatgagcccagtaccgcaaccgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaatactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgtcctgttatcttgaaatagaggggattgtttatctcccagataaaaacgccattctctgcctgaggagcagtgatgagttcccctgtgcgtgaatccatgattattgcagttgatatggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctaaatgaggaggtaggtcctggattgcagaggaagatagtgggaattccccctttaatttgaatgggcttcccgtactttgtgttgctttgccagtccctttgggcccccataaattccttgaagtgctttaaataatgcgggtctacgtcatcaacgacgttgtaccacgcatcgttactgtacacctttgggcttaggtctagatgtccacataaataattatgtgggcctagagacctggcccacattgttttgcctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcttttggggccttctcttttaatatattgagggccgcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgtttggatggaaatgtgctgacctgtttggggataccaggtcgaagaacctttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacagttgggatatgttaggaaataatttttggcatatattttaaataaacgaggcatgttgaaatgaatcggtgtccctcaaagctctatggcaatcggtgtatcggtgtcttacttatacctggacacctaatggctatttggtaatttcgtaaatgttcattgcaattcaaggttcaaaattcaaaaatcaaatcattaaagcggccatccgtataatatt

SEQ ID NO: 210 - DNA, 2781 bp, Tomato yellow leaf curl virus
accggatggccgcgccttttccttttatgtggtccccacgagggtttcacagacgtcactgtcaaccaatcaaattgcatcctcaaacgttagataagtgttcatttgtctttatatacttggtccccaagttttttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttacgagcaacgggatgatattaagcacactggtattgttcgttgtgttagtgatgttactcgtggatctggaattactcacagagtgggtaagaggttctgtgttaagtcgatatattttttaggtaaagtctggatggatgaaaatattaagaagcagaatcacactaatcaggtcatgttcttcttggtccgtgatagaaggccctatggaagcagcccaatggattttggacaggtttttaatatgttcgataatgagcccagtaccgcaaccgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattattaatggaaattacaccaagactatctaaatacttaagaacttgatatctaaatactctcaagaaacgaccagtctgaggctgtaatgtcgtccaaattcggaagttgagaaaacatttgtgaatccccattaccttcctgatgttgtggttgaatcttatttgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattattgcagttgagatggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatatttttttcttcgtctagataatccctatatgaggaggtaggtcctggattgcagaggaagatagtgggaattccccctttaatttgaatgggcttcccgtactttgtgttgctttgccagtccctttgggcccccatgaattccttgaagtgctttaagtaatgcgggtctacgtcatcaatgacgttgtaccacgcatcattattgtacacctttgggcttaggtctagatgtccacataaataattatgtgggcctagagacctggcccgcattgttttgcctgttctgctatcaccctcaatgacaatacttatgggtctccatggccgcgcagcggaatatacgacgttctcagcgacccattcttcaagttcatctggaacttgattaaaagaagaagaaataaatggagaaacataaacttctaaaggaggactaaaaatcctatctaaatttgaacttaaattatgaaattgcaaaatatagtcccttggggccttctcttttaatatattgagggcctcggatttattgcctgaattgagtgcttcggcatatgcgtcgttggcagattgctgacctcctctagctgatctgccatcgatttggaaaactccaaaatcaatgaagtctccgtctttccccacgtaggtcttgacatctgttgagctcttagctgcctgaatgttcggatggaaatgtgctgatctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacatttgggatatgttaagaaataatttttggcatatattttaaataaacgaggcatgttgaaatgaatcggtgtccctcaaagctctatggcaatcggtgtataggtgtcttatttatacctggacacctaatggctatttggtaatttcttaaaagtacattgcaattcaaaattcaaaattcaaaaatcaaatcattaaagcggccatccgtataatatt

SEQ ID NO: 211 - DNA, 2791 bp, Tomato yellow leaf curl virus
accggatggccgcgccctttctttttatgtggtccccatgagggttccacagacgtcactgtcaaccaatcaaattgcatcctcaaacgttagataagtgttcatttgtctttatatacttggtccccaagtagtttgtcttgcaatatgtgggatccacttgtaaatgaatttcctgaatctgttcacggatttcgttgtatgttagctattaaatatctgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtactgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccaatcttatgagcaacgggatgatattaagcacactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttctttttggtccgtgatagaaggccctatggaagcagcccaatggattttggacaggtttttaatatgttcgataatgagcccagtaccgcaaccgtgaagaatgatttgcgtgataggtttcaagtgatgaggaaatttcatgcaacagttattggtggtccctctggaatgaaggaacaggcattagttaagagattttttaaaattaacagtcatgtaacttataatcatcaggaggcagccaagtacgagaaccatactgaaaacgccttgttattgtatatggcttgtacgcatgcctctaatccagtgtatgcaactatgaaaatacgcatctatttctatgattcaatatcaaattaataaaatttatattttatatcatgagtttctgttacatctattgtgttttcaagtacatcatacaatacatgatcaactgctctgattatattgttaattgaaattacaccaatactatctaaatacttaagaacttgatgtctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaattgcctctggctgtgatctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgcctaattggtttcttcttggctatcttgtgttggaccttgattgatacttgcgaacagtggctcgtagagggtgatgaagattgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgtagtgctttaaataatgcgggtctacgtcatcaatgacgttgtaccacgcatcattactgtacacctttgggcttaggtctagatgtccacataaataattatgtgggcctagagacctggcccacattgttttgcccgttctgctatcaccctcaatgacaatacttatgggtctccatggccgcgcagcggaatacacgacgttctcggacacccatacttcaagttcatctggaacttgattaaaagatgaagataaaaagggagaaatataaggagccggaggctcctgaaaaattctatctaaattactatttaaattatgaaactgtaaaatataagcttttggtactaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttaccgacataagacttgacgtctgaactggatttagctccctgaatgtttgggtggaaatgtgctgccctgcttggggataccaggtcgaagaatctttgattttggcacttgaatttcccttcaaattggataagcacatggagatgtggttccccattctcgtggagttctctgcaaactttgatgtattttttatttgttggtgtttctaggttttttaattgggaaagtgcttcttcttttgttaaggagcaatgaggatatgtgaggaaataatttttgcaatttatttggaagcgcttaggaggagccatatggtcaatgagtaccgattgaccaagatttttacacttatccctggtgtatcggtactcaatatatagtgagtaccgaatggcattttggtaattacataaaagtacattgcaattcaaaaatcaaaattcaaaaatcaaatcattaaagcggccatccgtataatatt

SEQ ID NO: 212 - DNA, 2781 bp, Tomato yellow leaf curl virus
taatattaccggatggccgcgccttttccttttatgtggtccccacgagggttccacagacgtcactatcaaccaatcaaattgcatactcaaacgttaaataagtgttcatttgtctttatatacttggtccccaagtattttgtcttgcaatatgtgggacccacttctaaatgaatttcctgaatctgttcacggatttcgttgtatgctagctattaaatatttgcagtccgttgaggaaacttacgagcccaatacattgggccacgatttaattagggatcttatatccgttgtaagggcccgtgactatgtcgaagcgaccaggcgatataatcatttccacgcccgtctcgaaggttcgccgaacgctgaacttcgacagcccatacagcagccgtgctgctgtccccattgtccaaggcacaaacaagcgacgatcatggacgtacaggcccatgtaccgaaagcccaaaatatacagaatgtatcgaagccctgatgttccccgtggatgtgaaggcccatgtaaagtccagtcttatgagcaacgggatgatattaagcacactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttctttttggtccgtgatagaaggccctatggaagcagcccaatggattttggacaggtttttaatatgttcgataatgagcccagtaccgcaaccgtgaagaatgatttgcgtgataggtttcaagtgatgagaaaatttcatgcaacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaatggaaattacaccaagactatccaaatacttaagaacttcatatctaaatactcttaagaaatgaccagtctgaggctgaaatggcctccaaattcggaagttgagaaaacatttgtgaatccccattaccttcctgatgttgtggttgaatcttatctgaatggaaatgatgtcgtggttcattagaaatggccgctggctgtgttctgttatcttgaaatagaggggattgtttatctcccaaataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagcgcccaatttttcaaggatatatttttttcttcgtctagatattccctatatgaggaggtatgtcctggattgcagaggaagatagtgggatttccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaattacaatacttatgggtctccatggccgcgcagcggaagacacgacgttctcagcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttattgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctccctgaatgtttggatggaaatgtgctgccctgcttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaatcggtgtccctcaaagctctatggcaatcggtgtattggtgtcttatttatacctggacacctaatggctatttggtaatttcgtaaaagtacattgcaattcaaaattcaaaattcaaaaatcaaatcattaaagcggccatccgta

SEQ ID NO: 213 - DNA, 2781 bp, Tomato yellow leaf curl virus
accggatggccgcgccttttccttttatgtggtccccacgagggttacacagacgtcactgtcaaccaatcaaattgcatcctcaaacgttagataagtgttcatttgtctttatatacttggtccccaagtattttgtcttgcaatatgtgggaccctcttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgacccggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtgcagtcttatgagcaacgggatgatattaagcataccggtattgttcgttgtgtcagtgatgttactcgtggatctggaattactcacagagtgggtaagaggttctgtgttaaatcgatatattttttaggtaaagtctggatggatgaaaacatcaagaagcagaatcacactaatcaggtcatgttcttcttggtccgtgataggaggccctatggaaacagcccaatggattttggacaggtttttaatatgttcgataatgagcccagtaccgcaaccgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtatgagaaccatactgaaaacgccttgttattgtatatggcatgtacgcatgcctctaatcctgtgtatgcaactatgaaaatacgcatctatttctatgattcaatatcaaattaataacatttatattttatatcatgagcttctgttacatttattgtgttttcaagtacatcatacaatacatgatcaactgctctgattacattgttaatggaaattacaccaagactatctaaatacttaagaacttcatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggccgctggctgtgttctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagaccaatttttcaaggatatgtttttttcttcatctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacacatcgttattgtacacctttgggcttaggtctagatgtccacataaataattatgtgggcctagagacctggcccacattgtcttgcccgttctgctatcaccctcaatgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttggaaaactccaaaatcaatgaattctccgtctttctccacgtaggtcttgacatctgttgagctcttagctgcctgaatgttcggatggaaatgtgctgacctgtttggggataccaggtcgaagaaccgttggtttttacattggtatttgccttcgaattggataagcacatggagatgtggttccccattctcgtggaattctctgcaaactttgatgtattttttatttgttggggtttctaggttttttaattgggaaagtgcttcctctttagagagataacaattgggatatgtcaggaaataatttttggcatatattttaaataaacgaggcatgttgaaatgaatcggtgtccctcaaagctctatggcaatcggtgtattggtgtcttacttatacctggacacctaatggctatatggtaatttcataaatgtttattgcaattcaaaattcaaacttcaaaaatcaaatcattaaagcggccatccgtataatatt

SEQ ID NO: 214 - DNA, 2784 bp, Tomato yellow leaf curl virus
gttgaaatgaatcggtgtccctcaaagctctatggcaactcggtgtatcggtgtcttacttataccttggacacctaatggctatttggtaatttcataaatgttcattgcaattcaaaattcaaaattcaaaaatcaaatcattaaagcggccatccgtataatatttccggatggccgcgccttttccttttatgtggtccccagtgaaaattccacagacgtcactgtcaaccaatcaaattgcatcctcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgacgccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccactgtccaaggcacaaacaagcgacgatcatggacgtacaggcccatgtatcgaaagcccagaatatacagaatgtatcgaagccctgatgttccccgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaagcagcccaatggattttgggcaggtttttaatatgttcgataatgagcccagtaccgcaaccgtgaagaacgatttgcgggataggtttcaagtgatgaggaaatttcatgctacagttattggtgggccctctggaatgaaggaacaggtcttagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttttatgattcaatatcaaattaataaaatttatattttatatcatgagtttctgttacatttattgtgtttacaagtacatcgtacaatacatgatcaactgctctgattacattgttaatggaaattacaccaagactatctaaatatttaagaacttcatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctgactgtgttctgttatcttgaaatagaggggattgtttatctcccagataaaaacgccattctctgcctgaggagcagtgatgagttcccctgtgcgtgaatccatgattgttgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtattttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctactatcaccctcaatgacaatgcttatgggtctccatggccgcgcagcggaagacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgtttggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataattcttggcatatattttaaataaacgaggcat

SEQ ID NO: 215 - DNA, 2752 bp, Tomato yellow leaf curl virus
accggatgaccgcgccttttccttttatgtggtccccacgagggttacacagacgtcactgtcaaccaatcaaattgcatcctcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcaaccgtgctgctgtccccattgtccaaggcacaaacaagcgacgatcatggacgtacaggcccatgtaccgaaagcccagaatatacagaatgtatcgaagtcctgatattccccgtggatgtgaaggcccatgtaaagtccagtcttatgagcagcgggatgatattaagcacactggtgttgttcgttgtgttagtgatgttactcgtggatctggaattactcacagagtcggtaagaggttctgtgttaaatcgatatattttttaggtaaagtctggatggatgaaaatatcaagaagcagaatcacactaatcaggtcatgttctttttggtccgtgatagaaggccctatggaagcagtccaatggattttggacaggtttttaatatgttcgataatgagcccagtactgcaactgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattacaccaagactatctaaatacttaagaacttcatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctcgggctgtggtctgttatcttgaaatagaggggattgtttatctcccagataaaaacgccattctttgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagttggaattccccctttaatttgaatgggcttcccgtactttgtgttgctttgccagtccctctgggcccccatgaattctttgaagtgctttaaataatgcgggtctacgtcatcaatgacgttgtaccatgcatcattactgtacacctttgggcttaggtctagatgtccacataaataattatgtgggcctagagacctggcccacattgttttgcctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttctaaaggaggactaaaaatccgatctaaatttgaacttaaattatgaaattgtaaaatatagtcctttggggccttttcttttagtatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgtttggatggaaatgtgctgatctgtttggggataccaagtcgaagaaccgttggttcttacattggtatttgccttcgaattggataagcacatggagatgtggttccccattctcgtgaaattctctgcaaactttgatgtattttttatttgttggggtttctatgttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttatttatacctcgacacctaatggcaattcaaaattcaaaattcaaaaatcaaattattaaagcggtcatccgtataatatt

SEQ ID NO: 216 - DNA, 2791 bp, Tomato yellow leaf curl virus
accggatggccgcgccttttccttttatgtggtccccacgagggtttcacagacgtcactgtcaaccaatcaaattgcatcctcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcaacgggatgatattaagcacactggtattgttcgttgtgttagtgatgttactcgtggatctggaattactcacagagtgggtaagaggttctgtgttaagtcgatatattttttaggtaaagtctggatggatgaaaatattaagaagcagaatcacactaatcaggtcatgttcttcttggtccgtgatagaaggccctatggaagcagcccaatggattttggacaggtttttaatatgttcgataatgagcccagtaccgcaaccgtgaagaatgatttgcgtgataggtttcaagtgatgaggaaatttcatgttacagttattggtgggccctctggaatgaaggaacaggcattagttaagagattttttaagattaacagtcatgtaacttataatcatcaggaggcagccaagtacgagaaccatactgaaaacgccttgttattgtatatggcatgtacgcatgcctctaatccagtgtatgcaactatgaaaatacccatctatttctatgattcaatatctaattaataaaatttatattttatatcatgagtttctgttacatttattgtgttttcaagtacatcatacaatacatgatcaactgctctgattacattgttaatggaaattacaccaagactatctaaatacttaagaacttgatatctaaatacttttaagaaacggccagtctgaggctgtaatgtcgtccaaattcggaagttgagaaaacatttgtgaatccccattaccttccagatgttgtggttgaatcttatttgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattattgcagttgagatggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatatttttttcttggtctagatattccctatatgaggaggtaggtcctggatggcagaggaagatagtgggaattccccctttaatttgaatgggcttcccgtactttgtgttgctttgccagtccctttgggcccccatgaattccttgaagtgctttaagtaatgcgagtgtacgtcatcaatgacgttgtaccacgcatcattactgtacacctttgggcttaggtctagatgtccacataaataattatgtgggcctagagacctggcccacattgttttgcctgttctgctatcaccctcaatgacaatagttaagggtctccatggccgcgcagcggaatacacgacgttctcggacacccatacttcaagttcatctggaacttgattaaaagatgaagatagaaagggagaaatataaggagccggaggctcctgaaaaattctatctaaattactatttaaattatgaaactgtaaaatataatctttcggtactaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcatttgaatttcccttcaaattggataagcacatggagatgtggttctccattctcgtggagttctctgcaaactttgatgtattttttatttgttggggtttctaggttttttaattgggaaagtgcttcttcttttgttaaggagcaatgaggatatgtgaggaaataatttttgcaatttatttggaagcgcttaggaggagccatatggtcaatgagtaccgattgaccaagatttttacacttatccctggtgtatcggtactcaatatatagtgagtaccaaatggcattttggtaataacataaaagtacattgcaattcaaaattcaaaattaaaaaatcaaatcattaaagcggccatccgtataatatt

SEQ ID NO: 217 - DNA, 2790 bp, Tomato yellow leaf curl virus
atggtcaatgagtaccgattgaccaagatttttacacttatccctggtgtatcggtactcaatatatagtgagtaccaaatggcactttggtaattacataaaagtacattgcaattcaaaaatcaaaattcaaaaatcaaatcattaaagcggccatccgtataatattaccggatggccgcgccttttctttttatgctggtccccacgaggttccacagacgtcactgtcaaccaatcaaattgcatcctcaaacgttagatagtgttcatttgtctttatatacttggtccccaagtagtttgtcttgcaatatgtgggatccacttgtaaatgaatttcctgaatctgttcacggatttcgttgtatgttagctattaaatatctgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccagtcttatgagcagcgggatgatattaaacacactggtgttgttcgttgtgttagtgatgttactcgtggatctggaattactcacagagtcggtaagaggttctgtgttaaatcgatatattttttaggtaaagtctggatggatgaaaatatcaagaagcagaatcacactaatcaggtcatgttcttcttggtccgtgatagaaggccctatggaagcagtccaatggattttggacaggtttttaatatgttcgataatgagcccagtaccgcaaccgtgaagaatgatttgcgtgataggtttcaagtgatgaggaaatttcatgctacagttattggtgggccctctggaatgaaggaacaggcattagttaagagattttttaaaattaacagtcatgtaacttataatcatcaggaggcagccaagtacgagaaccacactgaaaacgccttgttattgtatatggcatgtacgcatgcctctaatccagtgtatgcaactatgaagatacgcatctatttctatgattcaatatcaaattaataaaatttatattttatatcatgagtttctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtattctgttatcttgaaatagaggggattgtttatctcccagataaaaacgccattctctgcttgaagggcagtgatgagttcccctgtgcgtgaatccatgattgttgcagttgatgtgtaggtagtatgagcagccacagtctaggtctacacgcttacgccttattggtttcttcttggctatcttgtgttggaccttgattgatacttgcgaacagtggctcgttgagggtgacgaagattgcattcttgagagcccaatttttcagggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagtgacctggcccacattgttttgcctgttctgctatcaccctcaatcacaatactgttaggtctccatggccgcgcagcggaagacatgacgttctcggacacccatacttcaagttcatctggaacttgattaaaagatgaagataaaaagggagaaatataaggagccggaggctcctgaaaaattctatctaaattactatttaaattatgaaactgtaaaatataatctttcggtactaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatctttgattttggcacttgaatttcccttcaaattggataagcacatggagatgtggttccctattctcgtggagttctctacaaactttgatgtattttttatttgttggtgtttcgaggttttttaattgggaaagtgcttcttcttttgttaaggagcaatgaggatatgtgaggaaataatttttgcaatttatttggaagcgcttaggaggagccat

SEQ ID NO: 218 - DNA, 2752 bp, Tomato yellow leaf curl virus
accggatggccgcgccttttccttttatgtggtccccacgagggttacacagacgtcactgtcaaccaatcaaattgcatcctcaaacgttagataagtgttcatttgtctttatatacttggtccccaagtattttgtcttgcaatatgtgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaagttcgccgaaggctgaacttcgacagcccatacagcaaccgtgctgctgtccccattgtccaaggcacaaacaagcgacgatcatggacgtacaggcccatgtaccgaaagcccagaatatacagaatgtatcgaagtcctgatgttccccgtggatgtgaaggcccatgtaaagtccagtcttatgagcagcgggatgatattaagcacactggtgttgttcgttgtgttagtgatgttactcgtggatctggaattactcacagagtcggtaagaggttctgtgttaaatcgatatattttttaggtaaagtctggatggatgaaaatatcaagaagcagaatcacactaatcaggtcatgttctttttggtccgtgatagaaggccctatggaagcagtccaatggattttggacaggtttttaatatgttcgataatgagcccagtaccgcaactgtgaagaatgatttgcgtgataggtttcaagtgatgaggaaatttcatgcaacagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattacgccaagactatctaaatacttaagaacttcatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctcgggctgtggtctgttatcttgaaatagaggggattgtttatctcccagataaaaacgccattctttgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcataggaagatagttggaattccccctttaatttgaatgggcttcccgtactttgtgttgctttgccagtccctctgggcccccatgaattctttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgacaatacttatgggtctccatggccgcgcagcggaagacacgacgttctcggcgacccactcttcaagttcatctggaacttgattaaaagaagaagaaagaaatggagaaacataaacttgtaaaggaggactaaaaatcctatctaaatttgaacttaaattatgaaattgtaaaatatagtcctttggggccttttcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgtttggatggaaatgtgctgacctgtttggggataccaggtcgaagaaccgttggttcttacattggtattttccttcgaattggataagcacatggagatgtggttccccattctcgtggaattctctgcaaactttgatgtattttttatttgttggggtttctatgttttttaattgggaaagtgcttcctctttagagagagaacaattgggatatgttaggaaataatttttggcatatattttaaataaacgaggcatgttgaaatgaatcggtgtccctcaaagctctatggcaatcggtgtatcggtgtcttatttatacctcgacccctaatggcaattcaaaattcaaaattcaaaaatcaaatcattaaagcggtcatccgtataatatt

SEQ ID NO: 219 - DNA, 2781 bp, Tomato yellow leaf curl virus
accggatggccgcgccttttctttttatgtggtccccacgagggttccacagacgtcactgtcaaccaatcaaattgcatcctcaaacgttagataagtgttcatttgtctttatatacttggtccccaagtagtttgtcttgcactatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatattaagaagcagaatcacactaatcaggtcatgttcttcttggttcgtgatagaaggccttatggaaacagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtatgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattaaaaatggcctctggctgtgttctgttatcttgaaatagaggggattgtttatctcccagataaaaacgccattctctgcttgaggagcagtgatgagttcccctgtgcgtgaatccatgattgttgcagttgatgtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctaaatgtccacataaataattatgtgggcctagagacctggcccacattgttttgcctgttctgctatcaccctcaacgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcctcggcatatgcgtcgttggcagattgctgacctcctctagctgatctgccatcgatttggaaaactccaaaatcaatgaagtctccgtctttttccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggtttttcaattgggaaagtgcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacaccaaatggctatttggtaattttgtaaaagtacattgcaattcaaaattcaaaattcaaaaatcaaatcattaaagcggccatccgtataatatt

SEQ ID NO: 220 - DNA, 2781 bp, Tomato yellow leaf curl virus
accggatggccgcgccttttccttttatgtggtccccacgagggttacacagacgtcactgtcaaccaatcaaattgcatcctcaaacgttagataagtgtgcatttgtctttatatacttggtccccaagttttttgtcttgcaatatgtgggacccacttcttaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaagcagcccaatggattttggacaggtttttaatatgttcgataatgagcccagtaccgcaaccgtgaagaatgatttgcgggataggtttcaagtgatgaggaaatttcatgcttcagttattggtgggccctctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatccactgctctgattacattgttaatggaaattacaccaagactatctaaatacttaagaactccatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctgactgtgttctgttatcttgaaatagaggggattgtttatctcccagataaaaacgccattctctgcctgaggagcagtgatgagttcccctgtgcgtgaatccatgattattgcagttgaggtcgaggtagtatgagcatccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattcctttaagtgttttaaattatgcgggtctacgtcatcaatgacgttataccacgcatcattactgtacacctttgggcttaggtctagatgtccacataaataattatgtgggcctagagacctggcccacattgttttgcctgttctgctatcaccctcaatgacaatacttatgggtctccatggccgcgcagcggataacacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatatactgcctgaattgagtgcttcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgttaggggataccaggtcgaagaaccgttggttcttacattggtattttccttcgaattggataagcacatggagatgtggttccccattctcgtggagttctctgcaaactttgatgtattttttatttgttggggtttctatgttttttaattgggaaagtgcttcctctttagagagagaacaattgggatatgttaggaaataatttttggcatatattttaaataaacgaggcatgttgatatgaatcggtgtccctcaaagctctatggcaatcggtgtatcggtgtcttacttatacctggacacctaatggctatttggtaatttcataaatgttcattgcaattcaaaattcaaaattcaaaaatcaaatcattaaagcggccatccgtataatatt

SEQ ID NO: 221 - DNA, 2781 bp, Tomato yellow leaf curl virus
accggatggccgcgccttttctttttatgtggtccccacaagggttccacagacgtcactgtcaaccaatcaaattgcatcctcaaacgttagataagtgttcatttgtctttatatacttggtccccaagtagtttgtcttgcactatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatattaagaagcagaatcacactaatcaggtcatgttcttcttggttcgtgatagaaggccttatggaaacagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtatgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggattgtttatctcccagataaaaacgccattctctgcttgaggagcagtgatgagttcccctgtgcgtgaatccatgattgttgcagttgatgtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctaaatgtccacataaataattatgtgggcctagagacctggcccacattgttttgcctgttctgctatcaccctcaatgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcctcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacaccaaatggctatttggtaattttgtaaaagtacattgcaattcaaaattcaaaattcaaaaatcaaatcattaaagcggccatccgtataatatt

SEQ ID NO: 222 - DNA, 2781 bp, Tomato yellow leaf curl virus
accggatggccgcgccttttccttttatgtggtccccacgagtgttccacagacgtcactgtcaaccaatcaaattgcatcctcaaacgttagataagtgttcatttgtctttatatacttggtcctcaagtagtttgtcttgcactatgtgggatccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatattaagaagcagaatcacactaatcaggtcatgttcttcttggttcgtgatagaaggccctatggaaacagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttagaattaacagtcatgtaacttataatcatcaggaggcagccaagtatgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattgttaattgaaattacaccaagactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctggatggaaatgatgtcgtggttcattagaaatggcctctggctgtgttctgttatcttgaaatagaggggattgtttatctcccagataaaaacgccattctctgcttgaggagcagtgatgagttcccctgtgcgtgaatccatgattgttgcagttgatgtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttctcttttaatatattgagggcctcggatttactgcctgaattgagtgcctcggcatatgcgtcgttggcagattgctgacctcctctagctgatctgccatcgatttggaaaactccaaaatcaatgaagtctccgtctttctccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagtgcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacacctaatggctatttggtaattttgtaaaagtacattgcaattcaaaattcaaaattcaaaaatcaaatcattaaagcggccatccgtataatatt

SEQ ID NO: 223 - DNA, 2781 bp, Tomato yellow leaf curl virus
accggatggccgcgccttttctttttatgtggtccccatgagggttccacagacgtcactgtcaaccaatcaaattgcatcctcaaacgttagataagtgtttatttgtctttatatacttggtccccaagtagtttgtcttgcactatgtgggatccacttctaaatgaatttcctgaatctgttcacggatttcgttgtatgttagctattaaatatttgcaggccgttgaggaaacttacgagcccaatacattgggccacgatttaattagggatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccggaagcccagaatatacagaatgtatcgaagccctgatgttcctcgtggatgtgaaggcccatgtaaagtccagtcttatgagcaacgggatgatattaagcatactggtattgttcgttgtgttagtgatgttactcgtggatctggaattacccacagagtgggtaagaggttctgtgttaaatcgatatattttttaggtaaagtctggatggatgaaaatattaagaagcagaatcacactaatcaggtcatgttcttcttggttcgtgatagaaggccctatggaaacagcccaatggattttggacaggtttttaatatgttcgataatgagcccagtaccgcaaccgtgaagaatgatttgcgggataggtttcaagtgatgaggaaatttcatgctacagttattggtgggccctctggaatgaaggaacaggcattagttaagagattttttagaattaacagtcacgtaacttataatcatcaggaggcagccaagtatgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattattaattgaaattacaccaagactatctaaatacttaagaacttgatatctaaatactcttaagaaacgaccagtctgaggctgtaatgtcgtccaaattcggaagttgagaaaacatttgtgaatccccaataccttcctgatgttgtggttgaatcttatctgaatggaaatgatgtcgtggttcattagaaatggcctctggctgtgttctgttatcttgaaatagaggggagagtttatctcccagataaaaacgccattctctgcttgaggagcagtgatgagttcccctgtgtgtgaatccatgattgttgcagttgatgtggaggtagtatgagcagccacagtctaggtctacacgcttacgccttatgggtttcttcttggctatcttgtgttggaccttgattgatacttgtgaacagtggctcgtagagggtgacgaaggttgcattcttgagagcccaatttttcaaggatatgtttttttcttcgtctagatattccctatatgaggaggtaggtcctggattgcagaggaagatagtgggaattccccctttaatttgaatgggcttcccgtactttgtgttgctttgccagtccctctgggcccccatgaattccttgaagtgctttaaataatgcgggtctacgtcatcaatgacgttgtaccacgcatcattactgtacacctttgggcttaggtctagatgtccacataaataattatgtgggcctagagacctggcccacattgttttgcctgttctgctatcaccctcaatgacaatacttatgggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattattaaattgtaaaatatagtcctttggggccttctcttttaatatattgagggcctcggatttactgcctgaattgagtgcctcggcatatgcgtcgttggcagattgctgacctcctctagctgatctgccatcgatttggaaaactccaaaatcaatgaagtctccgtctttttccacgtaggtcttgacatctgttgagctcttagctgcctgaatgttcggatggaaatgtgctgacctgtttggggataccaggtcgaagaaccgttggttcttacattggtatttgccttcgaattggataagcacatggagatgtggttccccattctcgtggagttctctgcaaactttgatgtattttttatttgttggggtttctaggttttttaattgggaaagggcttcctctttagagagagaacaattgggatatgttaggaaataatttttggcatatattttaaataaacgaggcatgttgaaatgaattggtgtccctcaaagctctatggcaatcggtgtatcggtgtcttacttatacctggacacctaatggctatttggtaattttgtaaaagtacaattcaattcaaaattcaaaattcaaaaatcaaatcattaaagcggccatccgtataatatt

SEQ ID NO: 224 - DNA, 2791 bp, Tomato yellow leaf curl virus
accggatggccgcgcctttttcttttatgtggtccccacgagggttccacagacgtcactgtcaaccaatcaaattgcatcctcaaacgttagataagtgtttatttgtctttatatacttggtccccaagttttttgtcttgcaatatgtgggacccacttctaaatgaatttcctgaatctgttcacggatttcgttgtatgttagctattaaatatttgcagtccgttgaggaaacttacgagcccaatacattgggccacgatttaattagagatcttatatctgttgtaagggcccgtgactatgtcgaagcgaccaggcgatataatcatttccacgcccgtctcgaaggttcgccgaaggctgaacttcgacagcccatacagcagccgtgctgctgtccccattgtccaaggcacaaacaagcgacgatcatggacgtacaggcccatgtaccgaaagcccagaatatacagaatgtatcgaagccctgatgttccccgtggatgtgaaggcccatgtaaagtccaatcttttgagcaacgggatgatattaagcatactggtattgttcgttgtgttagtgatgttactcgtggatctggaattactcacagagtgggtaagaggttctgtgttaaatcgatatattttttaggtaaagtctggatggatgaaaatatcaagaagcagaatcacactaatcaggtcatgttcttcttggtccgtgatagaaggccctatggaaacagtccaatggattttggacaggtttttaatatgttcgataatgagcccagtaccacaaccgtgaagaatgatttgcgggataggtttcaagtgatgaggaaatttcatgctacagttattggtgggccttctggaatgaaggaacaggcattagttaagagattttttaaaattaacagtcatgtaacttataatcatcaggaggcagccaagtacgagaaccatactgaaaacgccttgttattgtatatggcatgtacgcatgcctctaatccagtgtatgcaactatgaaaatacgcatctatttctatgattcaatatcaaattaataaaatttatattttatatcatgagtttctgttacatttattgtgttttcaagtacatcatacaatacatgatcaactgctctgattacattattaatagaaattacaccaagactatctaaatacttaagaacttgatatctaaatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctggctgtgttctgttatcttgaaatagaggggattgtttatctcccagataaaaacgccattctctgcctgaggagcagtgatgagttcccctgtgcgtgaatccatgattattgcagttgagatggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatatttttttcttcgtctagataatccctatatgaggaggtaggtcctggattgcagaggaagatagtgggaattccccctttaatttgaatgggcttcccgtactttgtgttgctttgccagtccctttgggcccccatgaattccttgaagtgctttaagtaatgcgggtctacgtcatcaatgacgttgtaccacgcatcattattgtacacctttgggcttaggtctagatgtccacataaataattatgtgggcctagagacctggcccacattgttttgcctgttctgctatcaccctcaatgacaatacttatgggtctccatggccgcgcagcggaatacacgacgttctcggacacccatacttcaagctcatctggaacttgattaaaagatgaagataaaaagggagaaatataaggagccggaggctcctgaaaaattctatctaaattactatttaaattatgaaactgtaaaatataatctttcggtactaattctttaatgattctaagagcctctgacttactgcctgagttaagagctgcggcgtaagcgtcattggctgactgctgacccccacgtgcagatcgtccgtcgatctgaaactcaccccagtcgacggtgtctccgtccttatcgacataagacttgacgtctgaactggatttagctccctgaatgtttggatggaaatgtgctgccctgcttggggataccaggtcgaagaatcgctgattttggcatttgaatttcccttcaaattggataagcacatggagatgtggttccccattctcgtggagttctctgcaaactttgatgtattttttatttgttggggtttctaggttttttaattgggaaagtgcttcttcttttgttaaggagcaatgaggatatgtgaggaaataatttttgcaatttatttggaagcgcttaggaggagccatatggtcaatgagtaccgattgaccaagatttttacacttatccctggtgtatcggtactcaacatatagtgagtaccaaatggcattttggtaataacataaaagtacattgcaattcaaaattcaaaattaaaaaatcaaatcattaaagcggccatccgtataatatt

SEQ ID NO: 225 - DNA, 2739 bp, Tomato leaf curl New Delhi virus
taatattaccgaatggccgcgcaaatttttaggtgggccctcaaccaatgaaattcacgctacatggcctatttagtgcgtggggatcaataaatagacttgctcaccaagtttggatccacaaacatgtgggatccattattgcacgaatttcccgaaagcgttcatggtctaaggtgcatgctagctgtaaaatatctccaagagatagaaaagaactattcaccagacacagtcggctacgatcttattcgagatctcattcttgttctccgagcaaagaactatggcgaagcgaccagcagatatcatcatttcaacgcccgcatcgaaggtacgccgacgtctcaacttcgacagcccctatggagctcgtgcagttgtccccattgcccgcgtcaccaaagcaaaggcctggaccaacaggccgatgaacagaaaacccagaatgtacagaatgtatagaagtcccgacgtgccaaggggctgtgaaggcccttgtaaagtgcagtcctttgaatctaggcacgatgtctctcatattggcaaagtcatgtgtgttagtgatgttacccgaggaactggactcacacatcgcgtagggaagcgattctgtgtgaaatctgtctatgtgctgggaaagatatggatggatgaaaacatcaagacaaaaaaccatactaacagtgtcatgttttttctggttcgtgaccgtcgtcctacaggatctccccaggatttcggggaagtgtttaatatgtttgacaatgaaccgagcacagcaacggtgaagaacatgcatcgtgatcgttatcaagtcttacggaagtggcatgcgactgtgacgggaggaacatatgcatctaaggagcaagcattagttaggaagtttgttagggttaataattatgttgtttataatcaacaagaggccggcaagtatgagaatcatactgaaaacgcattaatgttgtatatggcctgtactcacgcatcaaatcctgtatatgctactttgaaaatccggatctacttttatgattcggccacaaattaataaatatccagttttatatcatacgaagtccatacatcaattgtttgctccaatacattatccaatacatgataaactgctcttattacattataaattcctatgacacctaacatatccaggtacttaaggacctgggttttgaagactctcaagaaaatcccaatctgagggcgtaagcccgtccagattttgaaagttagaaaacacttgtgaagtcccagggctttccgcaggttgtggttgaactgtatttgaatcttgattatgtcgtgctgtgttaggaagggcctgctgtcgtgtttcaaaattttgaaatacaggggatttcgaatttcccaggtatatacgccactctctgctcgatccgcagtgatgtattcccctgtgcgtgaatccgtgatcatggcagttgatcgatatgtaatacgaacaaccacacggtagatcaactcgcctcctgcgaatgctcttcttcttcttctgggagagcgatgttttcgcgaccggaatagagtggttcttcgagtgtgatgaagactgcattcttgattgcccactgcttcagtgctgcatttttttcttcatccagatattccttatagctgctgtttggacctttattgcacaggaagatagtgggaattccacctttaatcatgaccggctttccgtacttcgtgttgctttggcagtcacgctgggcccccatgaattctttaaagtgctttagatagtggggatcaacgtcatcaatgacgttgtaccaggcatcattgctatagacctttgggctcagatcaagatgtccacacaagtaattgtgtggtcctaagcaccgagcccacatcgttttgcccgtcctactatccccctctatgactatgcttatgggcctaaaaggccgcgcagcggcacacacaacattagacgagacccaatcgacgaggtctgccggaactctgtcgaaggatgaaattgaaaatggagaaacataaacctcggaaggaggttgaaaaatacgatctaaattggtatttaaattgtgaaactgcagaacgtaatcttttggggctaattcctttaatactctcaaagcatcgtctttatttcccgtgttaatcgcctgggcatatgcatcgttcgccgtttgttgaccaccacgggcagatcgtccatcgatctggaaaacaccccattctagaacgtctccatctttggcgatgtagtttttgacgtccgacgctgatttagctccctgaatgttcggatggaaatgtgctgaccgacttggggaaaccaagtcgaagaatctgttatttttgcactggaatttcccttcgaattggatgagaacatggatatgcggagacccatcttcgtgaagctctctacagatcttgatgaatttcttcttcgtcggggtttctagggtttgcaattgggagagtgcctcttctttagttagagagcactttggatatgtgaggaaatagtttttggcatttactctaaaacgacgtggcgaagccataaaacttgtcgttttgattcggcgtccctcaacttatctatatgattggtgtctggagtcctatatataggtaagacaccatatggcattattgtaattttgaaaagaaaattactttaattcaaattccctaaagcggccattcgta

SEQ ID NO: 226 - DNA, 2739 bp, Tomato leaf curl New Delhi virus; identical to SEQ ID NO: 225

SEQ ID NO: 227 - DNA, 2739 bp, Tomato leaf curl New Delhi virus
taatattaccgaatggccgcgcaaatttttaggtgggccctcaaccaatgaaattcacgctacatggcctatttagtgcgtggggaccaataaatagacttgctcaccaagtttggatccacaaacatgtgggatccattgttggacgaatttccagaaagcgttcatggtctaaggtgcatgctagctgtaaaatatctccaagagatagaaaagaactattccccagacacagtcgggtacgatcttgtccgagatctcattcttgttctccgagcaaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcctgacgtgccaaggggctgtgaaggcccttgcaaggtgcagtcctttgaatccaggcacgatgtctctcatattggtaaagtcatgtgcgttagtgatgttacccgtggaactggactcacacatcgcgtagggaagcgattttgtgtgaaatctgtctatgtgctgggaaagatatggatggatgaaaacatcaagacaaaaaaccatactaacagtgtcatgttttttttggtccgtgaccgtcgtcctacaggatccccacaggattttggggaagtttttaacatgtttgacaatgaaccgagcacagcaacggtgaagaacatgcatcgtgatcgttatcaagtcttacggaagtggcatgcgactgtgacgggaggaacatatgcatctagggagcaagcattagttaggaagtttgttagggttaataattatgtagtttataatcaacaagaggccggcaagtatgagaatcatactgaaaatgccttaatgttgtatatggcctgtactcacgcatcaaatcctgtatatgctactttgaaaatccggatctatttctatgattcggtaacaaattaataaatatcaagctttatatcatatgaagtctgtacatcaatagtttgttccattacattatccaaaacatgataaactgctcttattacattataaattcctattacaccaagcatatccaggtacctaaggacctgggttttgaagactctcaagaaaatcccaatctgagggcgtaagcccgtccagattttgaaagttagaaaacacttgtgaagtcccagggctttccgcaggttgtggttgaattgtatttgaatcttgatgatgtcgtgctgtgttaggaagggcctgctgtcgtgcttcaaaattttgaaatacaggggatttcgaatttcccaggtatatacgccactctctgctcgatccgcagtgatgtactcccctgtgagtgaatccgtaatcatggcagttgatcgatatataatatgtacacccacacgggagatcaactcgcctcctgagaatgctcttcttcttcttctgtgggagcgatgttttcgcgaccggaatagagtggctcctcgagtgtgatgaagactgcattcttgattgcccactgtttcagtgctgcatttttctcttcgtccagatattccttatagctgctgggtggacctttattgcacaggaagatagtgggaattccacctttaatcatgactggctttccgtacttggtgttgctttgccagtcacgctgggcccccatgaattctttaaagtgctttagatagtggggatcaacgtcatcaatgacgttgtaccaggcatcattgctatacacctttgggctcagatcaagatgtccacacaagtaattgtggggtcctaagcatcgagcccacattgttttgcccgttctactatccccctcaatgactatgcttatgggcctaaaaggccgcgcagcggcacacacaacattgacactggcccaatcgacaagttctggaggaactcggtcgaaggatgaaattgaaaatggagaaacgtaaacctcagaacgaggttggaaaatgcgatccaaattgctaattagattatgaaactgcagaacataatcctttggggctaattcctttaatactttcaatgcatcttccttattccccgtgttaatcgccttagcatatgcatcggtggctgtctgctgaccaccacgagcagatcgtccatcgatctggaaaacaccccattctagaacgtctccgtctttgtcgatgtatgctttgacatctgacgctgatttagctccctgaatgttcggatggaaatgtgctgaccgacttggggaaaccaagtcgaagaatctgttatttttgcactggaatttcccttcgaattggatgagaacatggatatgcggagacccatcatcgtgcagctctctacagatcttgatgaatttcttcgcagttggggtttctagggtttgcaattgggaaagtgcctcttctttagttagagagcactttgggtatgtgaggaaatagtttttggcatctattctgaaacgacgtggcggagccataaaacttgtcgttttgattcggcgtccctcaacttcctctatgtaattggcgtctggcgtcccatatataggtaggacgctaaatggcaaaattgtaatttggaaaagaaaattactttaattcaaaatcctcatagcggccattcgt

SEQ ID NO: 228 - DNA, 2739 bp, Tomato leaf curl New Delhi virus
taatattaccgaatggcccgcgaaatttttaggtgggccctgaacgaatgaaaatcatgctacatggcctatttagtgcgtgggtaccaataaatagacttgctcaccaagtttggatccacaaacatgtgggatccattgttgcacgaatttccagaaagcgttcatggtctaaggtgcatgctagctgtaaaatatctccaagagatagaaaagaactactccccagacacagtcggctacgatcttgtccgagatctcattcttgttctccgagcaaagaactatggcgaagcgaccagcagatatcatcatttcaacgcccgcatcgaaggttcgccgacgtctcaacttcgacagcccctatggagctcgtgcagttgtccccattgcccgcgtcacaaaagcaaaggcctggacaaacaggccgatgaacagaaaacccagaatgtacagaatgtatagaagtcccgacgtgccaaggggttgtgaaggaccttgtaaggtgcaatcatttgaatccaggcacgatgtctctcatattggcaaagtcatgtgtgttagtagtgttacccgaggaactggactcacacatcgcgtggggaagcgattctgtgtgaaatccgtctatgtgctaggaaagatatggatggatgaaaacatcaagacaaaaaaccatactaacagtgtcatgttttttttagttcgtgaccgtcgtcctacaggagctccccatgattttggggaagtgtttaatatgtttgacaatgaaccgagcacagcaacggtgaagaacatgcatcgtgatcgttatcaagtgttacggaagtggcatgcgactgtgacgggaggaacatatgcatctaaggagaacgcattagttaggaagtttgttagggttaataattatgttgtttataatcaacaagaggcaggcaagtatgagaatcatactgaaaacgcattaatgttgtatatggcctgtactcacgcatcaaatcctgtatatgctactttgaaaatccggatctatttctatgattcggtcacaaattaataaatatcaagctttatatcataagacgtccatacatcaatcgtctgttccaatacattatccaatacatgataaactgctcttattacattatatattcctatgacacctaacatatccaggtacttaaggacctgggttttgaagactctcaagaaaatcccaatctgagggcgtaagcccgtccagatttggaaagttagaaaacacttgtgaagccccagggctttccgcaggttgtggttgaattgtatttgaatcttgattatgtcgtgctgtgttaggaagggcctgctgtcgtgtttcaaaattttgaaatacaggggatttcgaatttcccaggtatatacgccactctctgctcgatccgcagtgatgtattcccctgtgcgtgaatccgtgatcatggcagttgatcgatacgtaatacgaacaaccacacggaagatcaactcgcctcctgcgaatgctcttcttcttcttctgggggagcgatgttttcgcgaccggaatagagtggttcttcgagtgtgatgaagactgcattcttgattacccactgcttcagtgctgcattcttctcttcgttcagatattccttatagctgctgttcggacctttattgcacaggaagatagtgggaattccacctttaatcatgaccggctttccgtacttcgtgttgctttggcagtcacgctgggcccccatgaatactttaaagtgctttagatagaggggatcaacgtcatcaatgacgttgtaccaagcatcattgctatacacctttgggctcagatctagatgtccacacaagtaattgtgtggtcctaagcaacgagcccacattgttttgcccgtcctactatccccctctatgactacacttattggtctaaaaggccgcgcagcggcacacacaacattcgacgtcacccaatcgacgagttctggcggaactctgtcgaaggaagaaattgaaaatggagaaacataaacctcagaacgaggttgaaaaatgcgatctaaatttgtaattaaattgtgaaactgcagaacataatcctttggtgcaagttcttttaatactttcatcgcatcttctttatttcctgtgttaatcgcctgagcatatgcatcgtttgctgtttgctgaccaccacgagcagatcgtccatcgatctggaaaacaccccattctagaacgtctccgtctttgtcgatgtatgctttgcagtccgatgctgatttagctccctgaatgttcggatggaaatgtgctgaccgacttgggacaaccaagtcgaagaatctgttatttttgcattggaattttccttcgaattggatgagaacatggatatgcggagtcccatcttcgtgaagctctcgacagatcttgatgaatttcttcgaagttggggtttctagggttagtaattgggaaagtgcctcttcctttgtaagagagcactttggatacgtgaggaaatagttttttgcatttattctaaaacgacttggcggaggcataaaacttgtcgtttcgatccggtgtctctcaacttttctatgtaattggtgtctggagtcccatatataggtaagacaccatatggcagaattgtaattttgaaaagaaaattactttaattcaaaatccctaaagcggccattcgta

SEQ ID NO: 229 - DNA, 2739 bp, Tomato leaf curl New Delhi virus
accgaatggccgcgcaaatttttaggtgggccctcaacgaatgaaattgacggtacattgcttatatagtgcggggggaccaataaatagacttgctcacgaagtttggatccacaaacatgtgggatccattattgcacgaatttccagaaagcgttcatggtctacggtgcatgctagctgtaaaatatctccaagagatcgaaaagacctattccccagacacagtcggctacgatcttgtccgagatctcattcttgtccttcgagcgaagaactatggcgaagcgaccagcagatatcatcatttcaacgcccgcatcgaaggtacgccgacgactcaacttcgacagcccctatggaactcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcttttgaatctaggcacgacgtatcgcatattggcaaggtcatgtgtgtcagtgacgttacacgaggaactggactcacacatcgcgtagggaagcgattctgtgtgaaatccgtctatattctgggcaagatatggatggatgaaaacatcaagacaaaaaatcatactaacagtgtcatgttttttttggttcgtgaccgtcgtcctacaggaacaccccaagatttcggggaagtttttaacatgtttgacaatgaaccgagcacagcaacggtgaagaacatgcatcgtgaccgttatcaagtgttacggaagtggcatgcgactgtgacgggaggaacctacgcatctagggagcaagcattagttaggaagtttgttagggttaataattatgttgtttataatcaacaagaggccggcaagtatgagaatcatactgaaaacgcattaatgttgtatatggcctgtactcacgcatcaaatcctgtatatgctactttgaaaatccggatctatttctatgattcggtaacaaattaataaatatcgagctttatatcatatgaagtccatacatcaatcgtttgttccaatacattatccaatacatgataaactgcccttattacattataaattcctatgacacccaacctatccaggtacttaaggacctgggttttgaagactcgcaagaaaatcccaatcggagggcgtaagcccgtccagatttggaaagttagaaaacacttgtgaagtcccagggctttccgcaggttgtggttgaactgtatttgaatcttgattatgtcgtgctgtgttaggaagggtctgctgtcgtgtttcaaaattttgaaatacaggggatttcgaatttcccaggtatatacgccactctctgctcgatccgcagtgatgtactcccctgtgcgtgaatccgtgatcatggcagttgattgatatataatacgtgcacccacaatgcaaatcaactcgcctcctgcgaatgctcttcttcttcttctgtgggagcgatgttttcgcgaccggaatagagtggttcttcgagtgtgatgaagactgcattcttgattgcccactgcttcagtgctgcatttttttcttcgtccagatattccttatagctgctatttggacctttattgcacaggaagatagtgggaattcctcctttaatcatgacaggctttccgtacttcgtgttgctttgccagtcacgctgggcccccatgaattctttaaagtgctttagatagtgcggatcgacgtcatcaatgacgttgtaccatgcatcattgctatacacctttgggctcagatcgagatgtccacacaagtaattgtgtgggcctaagcaccgagcccacattgttttgcctgttctactatccccctcaattactatgcttatgggcctaaaaggccgcgcagcggcacagacaacattggacgacacccaatcgacgagttcaggaggaactctgtcgaaggatgaaattaaaaatggagacgcataaacctcagaaggaggttggaaaatgcgatctaaattgctaattaaattatgaaactgcagaacataatcttttggggctaattcctttaacactttcaatgcatcttctttattccccgtgttaatcgccttagcatatgcatcgttggccgtctgctgaccaccacgagcagatcgtccatcaatctggaaaacaccccattctagaacgtctccgtctttgtcgatgtatgctttcacatctgacgctgatttagctccctgaatgttcggatggaaatgtgctgaccgacttggggaaaccaagtcgaagaatctgttattcttgcactggaatttcccttcgaattggatgagaacatggatatgcggagacccatcctcgtgaagttctcgacagattttgatgaatttcttcgcagtcggggtttctagggtttgcaattgggaaagtgtctcttctttagttagagagcactttggatatgttaggaaatagtttttggcatctattctgaaacgacgtggcggagccataaaacttgtcgttttgattcggcgtccctcaacttcctctatgtaattggcgtctggcgtcccatatataggtaggacgctaaatggcagaattgtaattttggaaagaaaattactttaattcaaaaccctcatagcggccattcgttaatatt

SEQ ID NO: 230 - DNA, 2739 bp, Tomato leaf curl New Delhi virus
accgaatggccgcgcaaatttttaggtgggccctcaacgaatgaaattgacggtacattgcttatatagtgcggggggaccaataaatagacttgctcacgaagtttggatccacaaacatgtgggatccattattgcacgaatttcgagaaagcgttcatggtctacggtgcatgctagctgtaaaatatctccaagagatcgaaaagacctattccccagacacagtcggctacgatcttgtccgagatctcattcttgtccttcgagcgaagaactatggcgaagcgaccagcagatatcatcatttcaacgcccgcatcgaaggtacgccgacgactcaacttcgacagcccctatggaactcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagttttttgaatctaggcacgacgtatcgcatattggcaaggtcatgtgtgtcagtgacgttacacgaggaactggactcacacatcgcgtagggaagcgattctgtgtgaaatccgtctatattctgggcaagatatggatggatgaaaacatcaagacaaaaaatcatactaacagtgtcatgttttttttggttcgtgaccgtcgtcctacaggaacaccccaagatttcggggaagtttttaacatgtttgacaatgaaccgagcacagcaacggtgaagaacatgcatcgtgaccgttatcaagtgttacggaagtggcatgcgactgtgacgggaggaacctacgcatctagggagcaagcattagttaggaagtttgttagggttaataattatgttgtttataatcaacaagaggccggcaagtatgagaatcatactgaaaacgcattaatgttgtatatggcctgtactcacgcatcaaatcctgtatatgctactttgaaaatccggatctatttctatgattcggtaacaaattaataaatatcgagctttatatcatatgaagtccatacatcaatcgtttgttccaatacattatccaatacatgataaactgcccttattacattataaattcctatgacacccaacctatccaggtacttaaggacctgggttttgaagactcgcaaaaaaatcccaatcggagggcgtaagcccgtccagatttggaaagttagaaaacacttgtgaagtcccagggctttccgcaggttgtggttgaactgtatttgaatcttgattatgtcgtgctgtgttaggaagggtctgctgtcgtgtttcaaaattttgaaatacaggggatttcgaatttcccaggtatatacgccactctctgctcgatccgcagtgatgtactcccctgtgcgtgaatccgtgatcatggcagttgattgatatataatacgtgcacccacaatgcaaatcaactcgcctcctgcgaatgctcttcttcttcttctgtgggagcgatgttttcgcgaccggaatagagtggttcttcgagtgtgatgaagactgcattcttgattgcccactgcttcagtgctgcatttttttcttcgtccagatattccttatagctgctatttggacctttattgcacaggaagatagtgggaattcctcctttaatcatgacaggctttccgtacttcgtgttgctttgccagtcacgctgggcccccatgaattctttaaagtgctttagatagtgcggatcgacgtcatcaatgacgttgtaccatgcattattgctatacacctttgggctcagatcgagatgtccacacaagtaattgtgtgggcctaagcaccgagcccacattgttttgcctgttctactatccccctcaattactatgcttatgggcctaaaaggccgcgcagcggcacagacaacattggacgacacccaatcgacgagttcaggaggaactctgtcgaaggatgaaattaaaaatggagacgcataaacctcagaaggaggttggaaaatgcgatctaaattgctaattaaattatgaaactgcagaacataatcttttggggccaattcctttaacactttcaatgcatcttctttattccccgtgttaatcgccttagcatatgcatcgttggccgtctgctgaccaccacgagcagatcgtccatcaatctggaaaacaccccattctagaacgtctccgtctttgtcgatgtatgctttgacatctgacgctgatttagctccctgaatgttcggatggaaatgtgctgaccgacttggggaaaccaagtcgaagaatctgttattcttgcactggaatttcccttcgaattggatgagaacatggatatgcggagacccatcctcgtgaagttctcgacagattttgatgaatttcttcgcagtcggggtttctagggtttgcaattgggaaagtgtctcttctttagttagagagcactttggatatgttaggaaatagtttttggcatctattctgaaacgacgtggcggaggcataaaacttgtcgttttgattcggcgtccctcaacttcctctatgtaattggcgtctggcgtcccatatataggtaggacgctaaatggcagaattgtaattttggaaagaaaattactttaattcaaaaccctcatagcggccattcgttaatatt

SEQ ID NO: 231 - DNA, 2739 bp, Tomato leaf curl New Delhi virus
accgaatggccgcgcaaatttttaggtgggccctcaacgaatgaaattgacgctacattgcttatatagtgcggggggaccaataaatagacttgctcacgaagtttggatccacaaacatgtgggatccattattgcacgaatttccagaaagcgttcatggtctacggtgcatgctagctgtaaaatatctccaacagatcgaaaagacctattccccagacacagtcggctacgatcttgtccgagatctcattcttgtccttcgagcgaagaactatggcgaagcgaccagcagatatcatcatttcaacgcccgcatcgaaggtacgccgacgactcaacttcgacagcccctatggaactcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcttttgaatctaggcacgacgtatcgcatattggcaaggtcatgtgtgtcagtgacgttacacgaggaactggactcacacatcgcgtagggaagcgattctgtgtgaaatccgtctatattctgggcaagatatggatggatgaaaacatcaagacaaaaaatcatactaacagtgtcatgttttttttggttcgtgaccgtcgtcctacaggaacaccccaagatttcggggaagtttttaacatgtttgacaatgaaccgagcacagcaacggtgaagaacatgcatcgtgaccgttatcaagtgttacggaagtggcatgcgactgtgacgggaggaacctacgcatctagggagcaagcattagttaggaagtttgttagggttaataattatgttgtttataatcaacaagaggccggcaagtatgagaatcatactgaaaacgcattaatgttgtatatggcctgtactcacgcatcaaatcctgtatatgctactttgaaaatccggatctatttctatgattcggtaacaaattaataaatatcgagctttatatcatatgaagtccatacatcaatcgtttgttccaatacattatccaatacatgataaactgcccttattacattataaattcctatgacacccaacctatccaggtacttaaggacctgggttttgaagactcgcaagaaaatcccaatcggagggcgtaagcccgtccagatttggaaagttagaaaacacttgtgaagtcccagggctttccgcaggttgtggttgaactgtatttgaatcttgattatgtcgtgctgtgttaggaagggtctgctgtcgtgtttcaaaattttgaaatacaggggattttgaatttcccaggtatatacgccactctctgctcgatccgcagtgatgtactcccctgtgcgtgaatccgtgatcatggcagttgattgatatataatacgtgcacccacaatgcagatcaactcgcctcctgcgaatgctcttcttcttcttctgtgggagcgatgttttcgcgaccggaatagagtggttcttcgagtgtgatgaagactgcattcttgattgcccactgcttcagttctgcatttttttcttcgtccagatattccttatagctgctatttggacctttattgcacaggaagatagtgggaattcctcctttaatcatgacaggctttccgtacttcgtgttgctttgccagtcacgctgggcccccatgaattctttaaagtgctttagatagtgcggatcgacgtcatcaattacgttgtaccatgcattattgctatacacctttgggctcagatcgagatgtccacacaagtaattgtgtgggcctaagcaccgagcccacattgttttgcctgttctactatccccctcaattactatgcttatgggcctaaaaggccgcgcagcggcacagacaacattggacgacacccaatcgacgagttcaggaggaactctgtcgaaggatgaaattaaaaatggagacgcataaacctcagaaggaggttggaaaatgcgatctaaattgctaattaaattatgaaactgcagaacataatcttttggagctaattcctttaacactttcaatgcatcttctttattccccgtgttaatcgccttagcatatgcatcgttggccgtctgctgaccaccacgagcagatcgtccatcaatctggaaaacaccccattctagaacgtctccgtctttgtcgatgtatgctttgacatctgacgctgatttagctccctgaatgttcggatggaaatgtgctgaccgacttggggaaaccaagtcgaagaatctgttattcttgcactggaatttcccttcgaattggatgagaacatggatatgcggagacccatcctcgtgaagttctcgacagattttgatgaatttcttcgcagtcggggtttctagggcttgcaattgggaaagtgtctctgctttagttagagagcactttggatatgttaggaaatagtttttggcatctattctgaaacgacgtggcggagccataaaacttgtcgttttgattcggcgtccctcaacttcctctatgtaattggcgtctggcgtcccatatataggtaggacgctaaatggcagaattgtaattttggaaagaaaattactttaattcaaaaccctcatagcggccattcgttaatatt

SEQ ID NO: 232 - DNA, 2746 bp, Tomato leaf curl New Delhi virus
cggccattcgttaatattaccgaatggccgcgcaaatttttaggtgggccctcaaccaatgaaatgcacgctacaatgcttctttagtgcgtggggaccattaaatagacttgctcaccaagtttggatccacaaacatgtgggatccattattgcacgaatttccagaaagcgttcatggtctaaggtgcatgctagctgtaaaatatctgcaccgagataggaaaaggaactattcccccagacacagttcggctaccgatcttgtccgagatctcatccttgtccttcgagcgaagaactatggcgaagcgaccagcagatatcatcatttcaacgcccgcatcgaaggtacgccgacgtctcaacttcgacagcccctatggaactcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcttttgaatctaggcacgatgtatcgcatattggcaaggtcatgtgtgttagtgacgttacacgaggaactggactcacacatcgcgtagggaagcgattctgtgtgaaatccgtatatctgcagggcaagatatggatggatgaaaacatcaagacaaaaaaccatactaacagtgtcatgttttttttggttcgtgaccgtcgtcctacaggaacaccccaagacttcggggaagtttttaacatgtttgacaatgaaccgagcacagcaacggtgaagaacatgcatcgtgaccgttatcaagtcttacggaagtggcatgcgactgtgacgggaggaacctatgcatctagggagcaagcattagttaggaagtttgttagggttaataattatgttgtttataatcaacaagaggtcggcaagtatgagaatcatactgaaaacgcattaatgttgtatatggcctgtactcacgcatcaaatcctgtatatgctactttgaaaatccggatctatttctatgattcggtaacaaattaataaatatcgagctttatatcatatgaagtccatacatcaatcgtttgttccaatacattatccaatacatgataaactgcccttattacattataaattcctatgacacccaacctatccaggtacttaaggacctgggttttaaagactctcaagaaaatcccaatcggagggcgtaagcccgtccagattttgaaagttagaaaacacttgtgaagtcccagggctttccgcaggttgtggttgaactgtatttgaatcttgattatgtcgtgctgtgttaagaagggcctgctgtcgtgtttcaaaattttgaaatacaggggatttcgaatttcccaggtatatacgccactctctgctcgatccgcagtgatgtactcccctgtgcgtgaatccgtgatcatggcagttgattgatatataatacggtgcacccacactgcaaatcaactcgcctcctgcgagtgctcttcttcttcttctgtgggagcgatgttttcgcgaccggaatagagtggttcttcgagtgtgatgaagactgcatttttgattgcccactgcttcagtgctgcatttttttcttcgtccagatattccttatagctgctatttggacctggattgcacaggaagatagtgggaattcctcctttaatctggacaggctttccgtacttcgtgttgctttgccagacacgctgggcccccatgaattctttaaagtgctttagatagtgcggatcaacgtcatcaatgacgttgtaccaggcatcattgctatacacctttgggctcagatctagatgtccacacaagtaattgtgtgggcctaagcaccgagcccacattgtcttcccagttctactatccccctctattactatgcttatgggcctaaaaagccgcgcagcggcacagacaacattcgacgacacccaatcgacgagttgaggaggaactctgtcgaaggatgaaattgaaaatggagacgcataaacctcagacggaggttgaaaaatgcgatctaaattgctaattaaattatgaaactgcagaacataatcttttggggctaattcctttaacactttcaatgcatcttctttattccccgtgttaatcgccttagcatatgcgtcgttggccgtctgctgaccaccacgagcagatcgtccatcgatctggaaaacaccccattctagaacgtctccgtctttgtcgatgtatgctttgacatctgacgctgatttagctccctgaatgttcggatggaaatgtgctgaccgacttggggaaaccaagtcgaagaatctgttattcttgcactggaatttcccttcgaattggatgagaacatggatatgcggagacccatcctcgtgaagctctcgacagattttgatgaatttcttcgcagtcggggtttctagggcttgcaattgggaaagtgcctcttctttagttagaggacactttggatatgttaggaaatagtttttggcatctattctgaaacgacgtggcggagccataaaacgtgtcgttttgattcggcgtctctcaacttcctctatgtaattggcgtctggcgtcccatatataggtaggacgctaaatggcagaattgtaattttggaaagaaaattactttaattcaaaattctcatag

SEQ ID NO: 233 - DNA, 2740 bp, Tomato leaf curl New Delhi virus
accgaatggccgcgcaaatttttaggtgggccctcgaccaatgaaattcacgctacatggcttatttagtgcggggggaccaataaatagacttgctcaccaagtttggatccacaaatatgtgggatccattgttgcacgaatttccagaaagcgttcatggtctgaggtgcatgctagctgtaaaatatctccaagagatagaaaagaactattccccagacacagtcggatacgatcttgtccgagatctcattcttgttcttcgcgcaaagaactatgtcgaagcgaccagcagatatcatcatttcaacgcccgcatcgaaagtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcctttgaatccaggcacgatgtatctcatattggcaaagtcatgtgcgttagtgatgttacccgaggaactggactcacacatcgcgtagggaagcgattttgtgtgaaatctgtctatgtgcttggaaagatatggatggatgaaaacatcaagacaaaaaaccatactaacagtgtcatgttctttttggtccgtgaccgtcgtcctacaggatccccccaggattttggggaagtttttaacatgtttgataatgaaccgagcacagcaacggtgaagaacatgcatcgtgatcgttatcaagtcttacggaagtggcatgcgactgtgacgggaggaacatatgcatctaaggagcaagcattagttaggaagtttgttagggttaataattatgttgtttataatcaacaagaggccgggaagtatgagaatcatactgaaaacgcattaatgttgtatatggcctgtacgcacgcatcaaatcctgtgtatgctactttgaaaatccggatctatttttatgattcggtcacaaattaataaatatcgagctttatatcatatgttgcccatacatcaattgttcgctccaatacattatccaatacatgataaactgctcttattacattataaactcctattacaccgagcatatccaggtacttaaggacctgggttttgaagactctcaagaaaatcccaatctgagggcgtaagcccgtccagattttgaaagttagaaaacacttgtgaagtcctagggctttccgcaggttgtggttgaattgtatttgaatcttgatgatgtcgtgctgtgttaggaagggcctgctgtggtgttgcaaaattttgaaatacaggggatttcgaatttcccaggtatatacgccactctctgctcgatccgcagtgatgtattcccctgtgcgtgaatccgtgatcatggcagttgatcgatatataatacgaacaaccacacggcagatcaactcgcctcctgcgaatgctcttcttcttcttctgggggagcgatgttttcgcgacctgaatagagtggttcttcgagtgtgatgaagactgcattcttgattgcccactgcttcagtgctgcatttttttcttcgtccagatattctttatagctgctgtttggacctttattgcacaggaagatagtgggaattccacctttaatcatgaccggctttccgtatttcgtgttgctttgccagtcacgctgggcccccatgaattctttaaagtgctttagatagtggggatcaacgtcatcaatgacgttgtaccaggcatcattgctatacacctttgggctcagatcaagatgtccacacaagtaattgtggggtcctaaacatcgagcccacattgttttgcccgttctactatccccctcaatgactatgcttatgggcctaaaaggccgcgcagcggcacacaccacattggacgagacccaatcgacgagttctggcggaactctgtcgaaggatgaaattaaaaatggagaaacataaacctcagaaggaggttgaaaaatgcgatctaaattgctatttaaattgtgaaactgcagaacataatcctttggggctaattcctttaataatttcaacgcatcggctttatttcccgtgttaattgcctgagcatatgcatcgttcgccgtttgttgaccaccacgcgcagatcgtccatcgatctggaaaacgccccattctagaacgtctccgtctttgtcgatgtatgctttgacgtccgatgctgatttagctccctgaatattcggatggaaatgtgctgaccgacttggggaaaccaagtcgaagaatctgttatttttgcactggaattttccttcgaattggatgagcacatggatatgcggagacccatcctcgtgaagctctctgctgatcttgatgaatttcttcgcagttggggtttctagggtttgcaattgggaaagtgcctcttctttagttagagagcactttggatatgtgaggaaatagttttttgcattaattctaaaacgacgtggcggagccataaaacttgtcgttttgattcggagtctctcaacttgctctatgtaattggtgtctggggtcctatatataggtaagacaccaaatggcagaattgtaattttgaaaagaaaattactttaattcaaagtcactaaagcggccattcgtataatatt

SEQ ID NO: 234 - DNA, 2739 bp, Tomato leaf curl New Delhi virus
accgaatggccgcgcaaatttttaggtgggcccttgaccaatgaaattcacgctacatggcctatttagtgcgtggggatcaataaatagacttgctcaccaagtttggagccataaacatgtgggatccattattgcacgaatttccagaaagcgtggatggtctaaggtgcatgctagctgtaaaatatctccaagaaatagaaaagaactattggggagacacagtcggctacgatcttgtccgagatctcattcttgttctccgagcaaagaactatggcgaagcgaccagcagatatcatcatttcaacgcccgcctcgaaggtacgccgacgtctcaacttcgacagcccttatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcctttgaatcccggcacgatgtctctcatattggcaaagtcatgtgtgttagtgatgttacccgaggaaccggactcatacatcgcgtagggaagcgattctgtgagaaatccgtctatgtgcttggaaagatatggatggatgaaaacatcaagacaaaaaaccatactaacagtgtcatgttttttttggttcgtgaccgtcgtcctacaggatctccccaggatttcggggaagtgtttaatatgtttgacaatgaaccgagcacagcaacggtgaagaacatgcatcgtgatcgttatcaagtcttacggaagtggcatgcgactgtgacgggaggaacatatgcatctaaggagcaagcattagttaggaagtttgttagggttaataattatgttgtttataatcaacaagaggccggcaagtatgagaatcatactgaaaatgcattaatgttgtatatggcctgtactcacgcatcaaatcctgtgtatgctactttgaaaatccggatctatttctatgattcggtcacaaattaataaatatcgagctttatatcatatgaagtccatacatcaattgttctctccaatacattatctaatacatgatacactgctcttaatacattacaaattcctattacacctaacatatccaggtacttaagcacctgggttttgaagactctcaagaaaatcccaatctgagggcgtaagcccgtccagattttgaaagttagaaaacacttgtgaagtcccagggctttccgcaggttgtggttgaattgtatttgaatcttgattatgtcgtggtgtgttaggaagggcctgctgtcgtgttgcaaaattttgaaatacaggggatttcgaattacccaggtatatacgccactctctgctcgatccgcagtgatgtattcccctgtgcgtgaatccgtgatcatggcagttgatcgatatgtaatacgaacaaccacacggcagatcaactctcctcctgcggatgctcttcctcttcttctgtgggagcgatgttttcgcgaccggaatagagtggttcctcgagtgtgatgaagactgcattcttgattgcccactgcttcagtgctgcatttttttcttcgtccagatattccttatagctgctatttggacctttattgcacaggaagatagtgggaattccacctttaatcatgactggctttccgtacttcgtgttgctttgccagtcacgctgggcccccatgaattctttaaagtgctttagatagtggggatcaacgtcatcaatgacgttgtaccaagcatcgttgctatacacttttgggctcagatcaagatgtccacacaagtaattgtggggtcctaagcaccgagcccacattgttttgcccgttctactatccccctctatgactatgcttatgggcctaataggccgcgcagcggcacacacaacgttggacgagacccaatcgacgagttctgccggaactctgtcgaaggatgaaattgaaaatagagaaacataaacctcggaaggaggttgaaaaatgcgatctaaattggtatttaaattgtgaaattgcagaacataatcctttggggctaattcctttaatactttcaacgcatcgtctttatttcccgtgttaatcgcttgagcatatgcatcgttcgccgtctgttgaccaccacgggcagatcgtccgtcgatctggaaaacaccccattctagaacgtctccgtctttgtcgatgtactttttaacgtccgacgctgatttagctccctgaatgttcggatggaaatgtgctgaccggcttggggaaaccaagtcgaagaatctgttatttttgcactggaatttcccttcgaattggatgagaacatggatatgcggagacccatcctcgtgaaactctctacagatcttgatgaatttcttcttcgtcggcgtttctagggtttgcaattgggaaagtgcctcttctttagttagagagcactttggatatgtgaggaaatagtttttggcatttactctaaaacgacgtggcgaagccataaaacttgtcgttttgattcggcgtccctcaacttatctatgtaattggtgtctggagtcctatatataggtaagacaccatatggcattattgtaattttgaaaagaaaattactttaattcaaattccctaaagcggccattcgtataatatt

SEQ ID NO: 235 - DNA, 2740 bp, Tomato leaf curl New Delhi virus
accgaatggccgcgcaaattttttaggtgggccctcaaccaatgaaattcacgctacatggcctatttagtgcgtggggaccaataaatagacttgctcaccaagtttggatccacaaacatgtgggatccattattgcacgaatttccagaaagcgttcatggtctaaggtgcatgctagctgtaaaatatctccaagagatagaaaagaactattcaccagacacagtcggctacgatcttgtccgagatctcattcttgttcttcgggcaaagaactatggcgaagcgaccagcagatatcatcatttcaacgcccgcatcgaaagtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcctttgaatccaggcacgatgtctatcatattggcaaactcatgtgtgttagtgatgttacccgaggaaccggactcacacatcgcgtaggcaagcgattctgtgtgaaatctgtctatgtgctgggaaagatatggatggatgaaaacatcaagacaaaaaaccatactaacagtgtaatgttttttttggttcgtgaccgtcgtcctacaggagctccccaggatttcggggaagtgtttaatatgtttgacaatgaaccgagcacagcaacggtgaagaacatgcatcgtgatcgttatcaagtcttacggaagtggcatgcgactgtgacgggaggaacatatgcatctaaggagcaagcattagttaggaagtttgttagggttaataattatgttgtttataatcaacaagaggccggcaagtatgagaatcatactgaaaatgcattaatgttgtatatggcctgtactcacgcatcaaatcctgtatatgcaactttgaaaatccggatctatttctatgattcggtcacaaattaataaatatcgagctttatataatatgaagtccatacatcaatagttcgctccattacattatccaatacatgataaactgctcttattacattatatattcctatgacacctaacatatccaggtacttaaggacctgggttttgaagactctcaagaaaatcccaatctgagggcgtaagcccgtccagattttgaaagttagaaaacacttgtgaagtcccagggctttccgcaggttgtggttgaattgtatttgaatcttgatgatgtcgtgctgtgttaggaagggcctgctgtcgtgttgcaaaattttgaaatacaggggatttcgaatttcccaggtatatacgccattctttgctcgatccgcagtgatgtattcccctgtgcgtgaatccgtgatcatggcagttgatcgagatataataggaacaaccacacggcagatcaactcgcctcctgcgaatgctcttcttcttcttctgagggagcgatgttttcgcgaccggaatagagtggttcttcgagtgtgatgaagactgcattcttgattgcccactgcttcagtgctgcatttttttcttcgtccagatattccttatagctgctatttggacctttattgcacaggaagatagtgggaattccacctttaatcatgactggctttccgtacttcgtgttgctttgccagttacgctgggcccccatgaattctttaaaatgctttagatagtggggatcaacgtcgtcaatgacgttgtaccaggcatcattgctatacacttttgggctcagatcaagatgtccacacaagtaattgtggggtcctaagcaacgagcccacattgttttgccagttctactatcaccctctatgactatgcttatgggcctaaaaggccgcgcagcggcacacacaacattggacgagacccaatcgacgaggtctgccggaactctgtcgaaggatgaaattgaaaatggagaaacataaacctcggaaggaggttgaaaaatgcgatctaaattggtatttaaattgtgaaactgcagaacgtaatcctttggggctaattcctttaatactttcaaagcatcgtctttatttcccgtgttaatcgcctgggcatatgcatcgttcgccgtttgttgaccaccacgggcagatcgtccatcgatctggaaaacaccccattctagaacgtctccgtctttgtcgatgtattttttgacgtctgacgctgatttagctccctgaatgttcggatggaaatgtgctgaccgacttggggaaaccaagtcgaagaatctgttatttttgcattggaatttcccttcgaattggatgagaacatggatatgcggagacccatcttcgtgaagctctctacagatcttgatgaatttcttcttcgtcggggtttctagggtttgcaattgggaaagtgcctcttctttagttagagagcactttggatatgtgaggaaatagtttttggcatttactctaaaacgacgtggcgaagccataaaacttgtcgttttgattcggcgtccctcaacttatctatgtaattggtgtctggagtcctatatataggtaagacaccatatggcattattgtaattttgaaaagaaaattactttaattcaaattccctaaagcggccattcgtataatatt

SEQ ID NO: 236 - DNA, 2740 bp, Tomato leaf curl New Delhi virus
accgaatggccgcgcaaatttttatgtgggaccccgaccaatgaaattcgacctacatgacttctttaatgcatggggtcctttaaatagacttgctcaccaagtttggatccacaaacatgtgggatccattattgcacgaatttccagaaagcgttcatggtctaaggtgcatgctagctgtaaaatatctccaagagatagaaaagaactattccccagacacagtcggctacgatcttgtccgagatctcattcttgttctccgagcaaagaactatggcgaagcgaccagcagatatcatcatttcaacgcccgcatcgaaagtacgccgtcgtctcaacttcgacagcccctatggagctcgtgcacttgtccccattgcccgcgtcacaaaagcaaaggcctggacaaacaggccgatgaacagaaaacccagaatgtacagaatgtatagaagtcccgacgtgccaaggggatgtgaaggcccttgcaaggtgcagtccttcgaatccaggcacgatgtctctcatattggcaaagtcatgtgcgttagtgatgttacccgaggaactggactcacacatcgcgtaggaaagcgattttgtgtgaaatcagtttatgtgctggggaagatatggatggatgaaaacatcaagacgaaaaaccatactaacagtgttatgttttttttggtccgtgaccgtcgtcctacagggtccccccaagattttggggaagtttttaacatgtttgacaacgaaccgagcacagcaacggtgaagaacatgcatcgtgatcgttatcaagtgttacggaagtggcatgcgactgtgacgggaggaacatatgcatctagggagcaagcattagttaggaagtttgttagggttaataattatgtcgtgtacaatcaacaagaggccggcaagtatgagaatcatactgaaaacgcattaatgttgtatatggcctgtactcacgcatcaaatcctgtatatgctactttgaaaatccggatctatttctatgattcggtaacaaattaataaatatcaagctttatatcatatgaagtctgtacatcaatcgtctgttccaatacattatccaatacatgatacacagctcttattacattatatattcctatgacacctaacatatccaggtacttaagtacctgggttttgaagactctcaagaaaatcccaatctgagggcgtaagcccgtccagatttggaaagttagaaaacacttgtgaagccccagggctttccgcaggttgtggttgaattgtatttgaatcttgattatgtcgtgctctcttaggaagggcctgctgtggtgtttcaaaattttgaaatacaggggatttcgaatttcccaggtatatacgccactctctgctcgatccgcagtgatgtattcccctgtgcgtgaatccgtgatcatggcagttgatcgacacgtaataagaacaaccacacggaagatcaactcgcctcctgcgaatgctcttcttcttcttctgggggagcgatgttttcgcgaccggaatagagtggttcctcgagtgtgatgaagactgcattcttgattgcccactgcttcagtgctgcattcttctcttcgtccagatattccttatagctgctgttcggacctttattgcacaggaagatagtgggaattccacctttaatcatgactggctttccgtatttcgtgttgctttgccagtcacgctgggcccccatgaattctttaaagtgctttagatagtggggatcaacgtcatcaatgacgttgtaccaggcatcattgctatacacctttgggctgagatctagatgtccacacaagtaattgtgtgttcctaaacaacgagcccacattgttttgcccgtcctactatccccctctatgactacacttattggcctaaaaggccgcgcagcggcacacacaacgttggacgtgacccaatcgacgagttctggcggaactctgtcgaaggaagaaattgaaaatggagagacataaacctcagatcgaggttgaaaaatgcgatctaaatttgtaatcaaattgtgaaactgcagaacataatcctttggtgcaagttcttttaatactttcatcgcatcttctttatttcctgtattaatcgcctgagcatatgcatcgtttgccgtttgctgaccaccacgagcagatcgtccatcgatctgaaaaacaccccattctagaatgtctccgtctttgtcgatgtatgctttgacgtccgatgctgatttagctccctgaatgttcggatggaaatgtgctgaccgagttggggacaccaagtcgaagaatctgttatttttgcattggaattttccttcgaattggatgagaacatggatatgcggagacccatcctcgtgaagctctcgacagatcttgatgaatttcttcgaagttggggtttctagggtttgtaattgggaaagtgcctcttcctttgtaagagagcactttggatacgtgaggaaatagtttttcgcatttattctaaaacgacttggcggagccataaaactattcgtttcgatccggtgtctctcaactttctctatgtaattggtgtctggagtcccatatataggtaagacaccatatggcagaattgtaattttggaaagaaaattactttaattcaaattccctaaagcggccattcgtataatatt

SEQ ID NO: 237 - DNA, 2738 bp, Tomato leaf curl New Delhi virus
accgaatggccgcgcaaatttttaagtgggcccccacccaatgaaattcaagatacatggcttatttagtgcgtgggggccaataaatagacttgctcaccaagtttggatccacaaacatgtgggatccattattgcacgaatttccagaaagcgttcatggtgtaaggggcatgctagctgtaaaatatctccaagagatagagaagaactattcctccaacacagtcggctacgatcttgtccgagatctcattcttgttctccgagcaaagaactatggcgaagcgaccagcagatatcatcatttcaccgcccgcatcgaaggtaccccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcaatcttttgaatctaggcacgatgtctctcatattggcaaagtcatgtgtgttagtgatgttacccgaggaactggactcacacatcgcgtagggaagcgattctgtgtgaaatctgtctatgtgctgggaaagatatggatggatgaaaacatcaagacaaaaaaccatgctaacagtgtcatgttttttttagttcgtgaccgtcgtcctacaggatccccccaagattttggggaagtttttaacatgtttgacaatgaaccgagcacagcaacggtgaagaacatgcatcgtgatcgttatcaagtcttacggaagtggcatgcgactgtgacgggaggaacatatgcatctagggagcaagcattagttaggaagtttgttagggttaataattatgtagtttataatcaacaagaggcgggcaagtatgagaatcatactgaaaatgcattaatgttgtatatggcctgtactcacgcatcaaatcctgtatatgctactttgaaaatccggatctatttttatgattcggtaacaaattaataaatatcaagctttatatcatatgaagtctgtacatcaattgttcgctccaatacattatccaaaacatgataaactgctcttattacattataaattcctattacaccgagcatatccaggtacttaaggacctgggttttgaagactctcaagaaaatcccaatctgagggcgtaagcccgtccagattttgaaagttagaaaacacttgtgaagtcccagggctttccgcaggttgtggttgaactgtatttgaatcttgatgatgtcgtgctgtgttaggaagggcctgctgtcgtgtttcaaaattttgaaatacaggggatttcgaatttcccaggtatatacgccactctctgtacgatccgcagtgatgtactcccctgtgcgtgaatccgtgatcatggcagttgatcgatatgtaatacgaacacccacacggcagatcaactcgcctcctgcgaatgctcttcttcttcttctgcgggagcgatgttttcgcgaccggaatagagtggttcttcgagtgtgatgaagactgcattcttgattgcccactgcttcagtgctgcatttttttcttcgtccagatattccttatagctgctgtttggacctttattgcacaggaagatagtgggaattccacctttaatcatgactggctttccgtacttggggttgctttgccagtcacgctgggcccccatgaattctttaaagtgctttagatagtggggatcaacgtcatcaatgacgttgtaccaggcatcattgctatacacctttgggctcagatcaagatgtccacacaagtaattgtgtggtcccaagcgacgagcccacattgttttgcccgttctactatccccctctatgactatgcttatgggcctaaaaggccgcgcagcggcacacaccacattggacgagacccaatcgacgaggtctgccggaactctgtcgaaggatgaaattgaaaaaggagaaacataaacctcggaaggaggttgaaaaatgcgatctaaattggtatttaaattgtgaaactgcagaacataatcctttggggctaattcctttaatacgttcaacgcatcatctttatttcccgtattaatcgcctttgcatatgcatcgttggccgtctgctgaccaccacgagcagatcgtccatcgatctggaaaacaccccattctaggacgtctccgtccttgtcgatgtatgctttgacgtccgatgctgatttagctccctgaatgttcggatggaaatgtgttgaccgactaggggaaaccaagtcgaagaatctgttattcttgcactggtatttcccttcgaattggatgagaacatggatatgcggagacccatcctcgtgaagctctcgacagatcttgatgaatttcttcgaagtcggggtttctagggtttgcaattgggaaagtgcctcttcctttgtaagagagcactttggatatgtgaggaaatagtttttggcatttactctaaaacgacgtggggaagccataaaacctgtcgttttgattggcgtccctcaacttatctatgtgattggtgtctggagtcctatatataggtaagacaccatatggcagaattgtaattttgaaaagaaaattactttaattcaaattccctatagcggccactcgtctaatatt

SEQ ID NO: 238 - DNA, 2739 bp, Tomato leaf curl New Delhi virus
accgaatggccgcgcaaatttttaagtgggccctcaaccaatgaaattcaagatacatggcttatttagtgcgtgggggccaataaatagacttgctcaccaagtttggatccacaaacatgtgggatccactattgcacgaatttccagaaagcgttcatggtctaaggtgcatgctagctgtaaaatatctccaagagatagagaagaactattccccagacacagtcggctacgatcttgtccgagatctcattcttgttctccgagcaaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcaatcttttgaatctaggcacgatgtctctcatattggcaaagtcatgtgtgttagtgatgttacccgaggaactggactcacacatcgcgtagggaagcgattctgtgtgaaatctgtctatgtgctgggaaagatatggatggatgaaaacatcaagacaaaaaaccatgctaacagtgtcatgttttttttagttcgtgaccgtcgtcctacaggatccccccaagattttggggaagtttttaacatgtttgacaatgaaccgagcacagcaacggtgaagaacatgcatcgtgatcgttatcaagtcttacggaagtggcatgcgactgtgacgggaggaacatatgcatctagggagcaagcattagttaggaagtttgttagggttaataattatgtagtttataatcaacaagaggcgggcaagtatgagaatcatactgaaaatgcattaatgttgtatatggcctgtactcacgcatcaaatcctgtatatgctactttgaaaatccggatctatttttatgattcggtaacaaattaataaatatcaagctttatatcatatgaagtctgtacatcaattgttcgctccaatacattatccaaaacatgataaactgctcttattacattataaattcctattacaccgagcatatccaggtacttaaggacctgggttttgaagactctcaagaaaatcccaatctgagggcgtaagcccgtccagattttgaaagttagaaaacacttgtgaagtcccagggctttccgcaggttgtggttgaactgtatttgaatcttgatgatgtcgtgctgtgttaggaagggcctgctgtcgtgtttcaaaattttgaaatacaggggatttcgaatttcccaggtatatacgccactctctgtacgatccgcagtgatgtactcccctgtgcgtgaatccgtgatcatggcagttgatcgatatgtaatacgaacacccacacggcagatcaactcgcctcctgcgaatgctcttcttcttcttctgcgggagcgatgttttcgcgaccggaatagagtggttcttcgagtgtgatgaagactgcattcttgattgcccactgcttcagtgctgcatttttttcttcgtccagatattccttatagctgctgtttggacctttattgcacaggaagatagtgggaattccacctttaatcatgactggctttccgtacttggtgttgctttgccagtcacgctgggcccccatgaattctttaaagtgctttagatagtggggatcaacgtcatcaatgacgttgtaccaggcatcattgctatacacctttgggctcagatcaagatgtccacacaagtaattgtgtggtcccaagcgacgagcccacattgttttgcccgttctactatccccctctatgactatgcttatgggcctaaaaggccgcgcagcggcacacaccacattggacgagacccaatcgacgaggtctgccggaactctgtcgaaggatgaaattgaaaaaggagaaacataaacctcggaaggaggttgaaaaatgcgatctaaattggtatttaaattgtgaaactgcagaacataatcctttggggctaattcctttaatacgttcaacgcatcatctttatttcccgtattaatcgcctttgcatatgcatcgttggccgtctgctgaccaccacgagcagatcgtccatcgatctggaaaacaccccattctaggacgtctccgtccttgtcgatgtatgctttgacgtccgatgctgatttagctccctgaatgttcggatggaaatgtgttgaccgactaggggaaaccaagtcgaagaatctgttattcttgcactggtatttcccttcgaattggatgagaacatggatatgcggagacccatcctcgtgaagctctcgacagatcttgatgaatttcttcgaagtcggggtttctagggtttgcaattgggaaagtgcctcttcctttgtaagagagcactttggatatgtgaggaaatagtttttggcatttactctaaaacgacgtggcgaagccataaaacctgtcgttttgattcggcgtccctcaacttatctatgtgattggtgtctggagtcctatatataggtaagacaccatatggcagaattgtaattttgaaaagaaaattactttaattcaaattccctatagcggccattcgtctaatatt

SEQ ID NO: 239 - DNA, 2739 bp, Tomato leaf curl New Delhi virus
accgaatggccgcgcaaatttttaggtgggccctcaaccaatgaaattcacgctacatggcttatttagtgcgtggggaccaataaatagacttgctcaccaagtttggatccacaaacatgtgggatccattactgcacgaatttccagaaagcgttcatggtctaaggtgcatgctagctgtaaaatatctccaagagatagaaaagaactattccccagacacagtcggctacgatcttgtccgagatctcattcttgttcttcgggcaaagaactatggcgaagcgaccagcagatatcatcatttcaacgcccgcatcgaaagtacgccgacgtctcaacttcgacagcccctatggagctcgtgcagttgtccccattgcccgcgtcacaaaggcaaaggcctggaccaacaggccgatgaacagaaaacccagaatgtacagaatgtatagaagtcccgacgtgccaaggggctgtgaaggcccttgtaaggtgcagtcctttgaatctaggcacgatgtctatcatattggcaaagtcatgtgtgttagtgatgttacccgaggcactggactcacacatcgcgtagggaagcgtttctgtgtgaaatccgtctatgtgctgggaaagatatggatggatgaaaacatcaagacaaaaaaccatactaacagtgtcatgttttttctggttcgtgaccgtcgtcctacaggatccccccaagatttcggggaagtgtttaatatgtttgacaatgaaccgagcacagcaacggtgaagaacatgcatcgtgatcgttatcaagtcttacggaagtggcatgcgactgtgacgggaggaacatatgcatctaaggagcaagcattagttaggaagtttgttagggttaataattatgttgtttataaccaacaagaggccggcaagtatgagaatcatattgaaaacgcattaatgttgtatatggcctgtactcacgcatcaaatcctgtatatgctactttgaaaatccggatctacttttatgattcggtcacaaattaataaatatccagttttatatcatacgaagtccatacatcaattgttcgctccaatacattatccaatacatgataaactgctcttattacattataaattcctatgacacctaacatatccaggtacttaaggacctgggttttgaagactctcaagaaaatcccaatctgagggcgtaagcccgtccagattttgaaagttagaaaacacttgtgaagtcccagggctttccgcaggttgtggttgaactgtatttgaatcttgattatgtcgtgctgtgttaggaagggcctgctgtcgtgtttcaaaattttgaaatacaggggatttggaacctcccagataaacacgccactctctgtacgatccgcagtgatgtattcccctgtgcgtgaatccgtgatcatggcagttgatcgatatataataggaacaaccacacggcagatcaactcgcctcctgcgaatgcccttcttcttcttctgggggagcgatgttttcgcgaccggaatagagtggttcttcgagtgtgatgaagactgcattcttgattgcccactgcttcagtgctgcatttttttcttcgtccagatattccttatagctgctgtttggacctttattgcacaggaagatagtgggaattccacctttaatcatgactggctttccgtacttcgtgttgcgatgccagtccctttgggcccccatgaactctttaaagtgctttagatagtggggatcaacgtcatcaatgacgttgtaccaggcatcattgctatacacctttgggctcagatcaagatgtccacacaagtaattgtggggtcccaagcaccgagcccacattgttttgcccgttctactatccccctctatgactatgcttatgggcctaaaaggccgcgcagcggcacacaccacattggacgaagcccaatcgacgagttctggcggaaccctgtcgaaggaagaaattgaaaatggagaaacataaacctcagaacgaggttgaaaaatgcgatctaaatttgtaactaaattgtgaaactgcaaaacataatcttttggcgctaattctttcaatactttcaacgcatcctctttatttcctgtattaattgcttgggcatatgcatcgttggccgtctgttgacctccacgagcagatcgtccatcgatctggaaaacaccccattctagaacgtctccgtctttgtcgatgtatttcttgacatctgacgctgatttagctccctgaatgttcggatggaaatgtgctgaccgacttggggaaaccaagtcgaagaatctgttatttttgcattggaattttccttcgaattggatgagaatatggagatgcggagacccatcttcgtgaagctctctacagatcttgatgaatttcttcgcagttggggtttctagggtttgcaattgggaaagtgcctcttctttagttagagagcacttcggatatgtgaggaaatagtttttggcatctattctaaaacgacgtggcggagccattaaacttgtcgttttgattcggcgtccctcaacttcctctatgtaattggcgtctggcgtcccatatataggtaggacgctaaatggcagaattgtaattttgaaaagaaaattactttaattcaaaatcctcatagcggccattcgttaatatt

SEQ ID NO: 240 - DNA, 2740 bp, Tomato leaf curl New Delhi virus
accgaatggccgcgcaaatttttaggtgggccctcaaccaatgaaattcgagctacatggcttctttgctgcgtggggaccaataaatagacttactcaccaagtttggatccacaaacatgtgggatccattattgcacgaatttccagaaagcgttcatggtttaaggtgcatgctagctgtaaaatatctccaagagatagaaaagaactattccccagacacagtcggctacgatcttgtccgagatctcattcttgttcttcgagcaaagaactatggtgaagcgaccagcagatatcatcttttcaacgcccgtatcgaaagtacgccgtcgtctcaacttcgacagcccctttggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcctttgaatctaggcacgatgtctctcatattggcaaagtcatgtgtgttagtgatgttacccgaggatctggactcacacatcgcgtagggaagcgattttgtgtgaaatctgtctatgtgctggggaagatatggatggatgaaaacatcaagacaaaaaaccatactaacagtgtcatgttttttttggtccgtgaccgtcgtcctacaggatctccacaagattttggggaagtttttaacatgtttgacaatgaaccgagcacagcaacggtgaagaacatgcatcgtgatcgttatcaagtcttacggaagtggcatgctactgtgacgggaggaacatatgcatctaaggagcaagcattagttaggaagtttgttagggttaataattatgttgtctataaccaacaagagtccggcaagtatgagaatcatactgagaacgcattaatgttgtatatggcctgtactcatgcatcaaatcctgtgtatgctactttgaaaatccggatctatttctatgattcggtaacaaattaataaagatcgagttttatatcatatgaagtccatacatcaatcgtttgttccattacattatccaaaacatgataaactgctcttattacattataaattcctattacaccaagcctatccaggtacctaaggacctgtgttttgaagactctcaagaaaatcccaatctgagggcgtaagcccgtccagattttgaaagttagaaaacacttgtgaagtcccagggctttccgcaggttgtggttgaattgtatttgaatattgatgatgtcgtgctgtcttaggaagggtctgctgttgtgtttcaaaattttgaaatacaggggatttcgaatttcccaggtatatacgccactctctgctcgatccgcagtgatggactcccctgtgcgtgaatccgtgatcatggcagtggatcgagcagtaatacgtacacccacactgcagatcaactcgcctcctgcgaatgctcttcttcttcttctgtgggagcgatgttttcgcgaccggaatagagtggttcttcgagtgtgataaagactgcattcttgattgcccactgcttcagtgctacgtttttttcttcgtccagatattccttatagctgctgtttggacctttattgcacaggaagatagtgggaattccacctttaatcatgactggctttccgtacttcgtgttgctttgccagtcacgctgggcccccatgaattctttaaaatgctttagatagtgtggatcaacgtcatcaatgacgttgtaccaggcctcattgctatacacctttgggctcagatcaagatgtccacataagtaattatggggtcctaagcaacgagcccacattgttttgcccgttctactatccccctctatgactatgcttatgggcctgaaaggccgcgcagcggcacacaccacattggacgacacccaatcgacgagttctggcggaactctgtcgaaggatgaaattgaaaatggagaaacataaatctcagaaggaggttgaaaaatgcgatctaaattggtatttaaattgtgaaactgcagaacataatcctttggggctaattcctttaatactttcaacgcatcgtctttatttcccgtgttaatcgcctgagcatatgcatcgttcgccgtttgttgaccaccacgagcagatcgtccatcgatctggaaaataccccattctagaacgtctccgtctttgtcgatgtactttttgacgtccgatgctgatttagctccctgaatgttcggatggaaatgtgctgaccgacttggggaaaccaagtcgaagaatctgttatttttgcactggaatttgccttcgaattggatgagaacatggatatgcggagacccatcctcgtgaagctctctacatatcttaatgaattttttcgcagttggggtttctagggttcgcagttgggaaagtgcgtcctccttagttagagagcactttggatatgtgaggaaatagtttttggcatttattctaaaacgacgtggtggagtcataaaacttgtcgttttgattcggcgtccctcaactctctctatgtaattggtgtctggagtcctatatataggtaagacaccatatggcagaattgtaattttgaaaagaaaattactttaattcaaattccctaaagcggccattcgtataatatt

SEQ ID NO: 241 - DNA, 2740 bp, Tomato leaf curl New Delhi virus
accgaatggccgcgcaaatttttaggtgggccctcaaccaataaaattcgagctacatggcttctttgctgtgcggggaccaataaatagacttactcactaagtttggatccacaaatatgtgggatccattattgcacgaatttccagaaagcgttcatggtgtcaggtgcatgctagctgtaaaatatctccaagagatagaaaagaactattccccagacacagtcggatacgatcttgtccgagatctaattcttgttcttcgagcaaagaactatggtgaagcgaccagcagatatcatcttttcaacgcccgcatcgaaagtacgccgacgtctcaacttcgacagcccctttggagctcgtgcagttgtccccattgcccgcgtcacaaaagcaaaggcctggaccaacaggccgatgaacagaaaacccagaatatacagaatgtatagaagtcccgacgtgccaaggggatgcgaaggtccttgtaaggtgcagtcctttgaatctaggcacgatgtctctcatattggcaaagtcatgtgtgttagtgatgttacccgaggttctggactcactcatcgcgtagggaagcgattttgtgtgaaatctgtctatgtgctggggaagatatggatggatgaaaacatcaagacaaaaaaccatactaacagtgtcatgttttttttggtccgtgaccgtcgtcctacaggatctccacaagattttggggaagtttttaacatgtttgacaatgaaccgagcacagcaacggtgaagaacatgcatcgtgatcgttatcaagtcttacggaagtggcatgctactgtgacgggaggaacatatgcatctaaggagcaagcattagttagcaagtttgttagggttaataattatgttgtgtataaccaacaagaggccggcaagtatgagaatcatactgaaaacgcattaatgttgtatatggcctgtactcatgcatcaaatcctgtgtatgctactttgaaaatccggatctatttctatgattcggtaacaaattaataaatatcgagttttatatcatatgaagtacatacatcaatcgtttgttccattacattatccaatacatgataaactgctcttattacattataaattcctattacaccaaccatatccaggtacctaaggacctgtgttttgaagactctcaagaaaatcccaatctgagggcgtaagcccgtccagattttgaaagttagaaaacacttgtgaagtcccagggctttccgcaggttgtggttgaattgtatttgaatattgatgatgtcgtgctgtcttaggaagggtctgctgttgtgtttcaaaattttgaaatacaggggatttcgaatttcccaggtatatacgccactctctgctcgatccgcagtgatggactcccctgtgcgtgaatccgtgatcatggcagttgatcgatatgtaatacgtacacccacactgcagatcaactcgcctcctgcgaatgctcttcttcttcttctgtgggagcgatgttttcgcgaccggaatagagtggttcttcgagtgtgataaagactgcattcttgattgcccagtgcttcagtgctgcgtttttttcttcgtccagatattccttatagctggtgtttggacctttattgcacaggaagatagtgggaattccacctttaatcatgactggctttccgtatttcgtgttgctttgccagtcacgctgggcccccatgaattctttaaagtgctttagataatgtggatcaacgtcatcaatgacgttgtaccaggcctcattgctatagacctttgggctcagatcaagatgtccacacaagtaattgtggggtcctaaacaacgagcccacattgttttgcccgttctactatccccctctatgactatgcttatgggcctaaaaggccgcgcagcggcacacaccacatttgacgagacccaatcgacgagttctggcggaactctgtcgaaggatgaaattgaaaatggagaaacataaatctcagaaggaggttgaaaaatgcgatctaaattggtatttaaattgtgaaactgcagaacataatcctttggggctaattcctttaatactttcaacgcatcgtctttatttcccgtgttaatcgcctgagcatatgcatcgtttgccgtttgttgaccaccacgagcagatcgtccatcgatctggaaaacaccccattctagaacgtctccgtctttgtcgatatactttttgacgtctgatgctgatttagctccctgaatgttcggatggaaatgtgctgaccgacttggggaaaccaagtcgaagaatctgttatttttgcactggaatttcccttcgaattggatgagaacatggatatgcggagacccatcctcgtgaagctctctacatatcttgatgaattttttcgcagttggggtttctagggtttgcagttgggaaagtgcgtcctccttagttagagagcactttggatatgtgaggaaatagtttttggcatttattctaaaacgacgtggcggagacataaaacttgtcgttttgattcggcgtccctcaacttcttctatgtaattggtgtctggagtcctttatataggtaagacaccatatggcagaattgtaattttgaaaagaaaattactttaattcaaattccctaaagcggccattcgtttaatatt

SEQ ID NO: 242 - DNA, 2738 bp, Tomato leaf curl New Delhi virus
accgaatggccgcgcaaatttttatgtgggaccgcgaccaatgaaattcaagcttcgtggcttatgtaatgcatggggtcctttaaatagacttgctcaccaagtttggatccacaaacatgtgggatccattattgcacgaatttccagaaagcgttcatggtctaaggtgcatgctagctgtaaaatatctccaagagatagaaaagaactattccccagacacagtcggatacgatcttgtccgagatctcattcttgttctccgagcaaagaactatggcgaagcgaccagcagatatcatcatttcaacgcccgcatcgaaagtacgccgtcgtctcaacttcgacagcccctatggagctcgtgcagttgtccccattgcccgcgtcacaaaagcaaaggcctggacaaacaggccgatgaacagaaaacccagaatgtacagaatgtatagaagtcccgacgtgccaaggggatgtgaaggcccttgcaaggtgcagtccttcgaatccaggcacgatgtctctcatattggcaaagtcatgtgcgttagtgatgttacccgaggaactggactcacacatcgcgtaggaaagcgattctgtgtgaaatctgtctatgtgctggggaagatatggatggatgaaaacatcaagacgaaaaaccatactaacagtgttatgttttttttggtccgtgaccgtcgtcctacaggatccccccaagattttggggaagtttttaacatgtttgacaatgaaccgagcacagcaacggtgaagaacatgcatcgtgatcgttatcaagtgttaaggaagtggcatgcgactgtgacgggaggaacatatgcatctagggagcaagcattagttaggaagtttgttagggttaataattatgtcgtttacaatcaacaagaggccggcaagtatgagaatcatactgaaaacgcattaatgttgtacatggcctgtactcacgcatcaaatcctgtatatgctactttgaaaatccggatctatttctatgattcggtcacaaattaataaatatcgagttttatatcatatgaagtccatacatcaatcgtctgttccaatacattatccaatacatgataaactgctcttattacattataaattcctatgacacctaacatatccggtacttaaggacctgggttttgaagactctcaagaaaatcccaatctgagggcgtaagcccgtccagatttggaaagttagaaaacacttgtgaagccccagtgctttccgcaggttgtggttgaattgtatttgaatcttgattatgtcgtgctgtgttaggaagggcctgctgtcgtgtttcaaaattttgaaatacaggggatttcgaatttcccaggtatatacgccactctctgctcgatccgcagtgatgtattcccctgtgcgtgaatccgtgatcatggcagttgattgatacgtaatacgaacaaccacacggaagatcaactcgcctcctgcgaatgctcttcttcttcttctgggggagcgatgttttcgcgaccggaatagagtggttcttcgagtgtgatgaagactgcattcttgattgcccagtgcttcagtgcggcattcttctcttcgtccagatattcctatagctgctgttcggacctttattgcacaggaatatagtgggaattccacctttaatcatgactggctttccgtacttcgtgttgctttgccagtcacgctgggcccccatgaattctttaaaatgctttagatagtggggatcaacgtcatcaatgacgttgtaccaggcatcattgctatacacctttgggctgagatctagatgtccacacaagtaattgtgtggtcctaagcaacgagcccacattgttttgcccgtcctactatccccctctatgactacacttattggcctaaaaggccgcgcagcggcacacacgacgttcgacgtgacccagtcgacgagttctggcggaactctgtcgaaggaagaaattgaaaatggagagacgtaaacctctgaacgaggttgaaaaatgcgatctaaatttgtaatcaaattgtgaaactgcaaaacatagtcctttggtgcaagttcttttaatactttcatggcatcttctttatttcctgtgttaatcgcctgagcatatgcatcgttcgccgtttgctgaccaccacgagcagatcgtccatcgatctggaaaacaccccattctagaatgtctccgtctttgtcgatgtatgctttgacgtccgatgctgatttagctccctgaatgttcggatggaaatgtgttgaccgacttggggacaccaagtcgaagaatctgttatttttgcattggaattttccttcgaattggatgagaacatggatatgcggagacccatcctcgtgaagctctcgacagatcttgatgaatttcttcgaagttggggtttcgagggtttgtaattgggaaagtgcctcttcctttgtaagagagcactttggatacgtgaggaaatagtttttcgcatttattctaaaacgacttggcggagccataaaactagtcgtttcgatccggtgtctctcaactttctctatgtaattggtgtctggagtcccatatataggtaagacaccatatggcagaattgtaattttgaaaagaaaattactttaattcaaattccctaaagcggccattcgtataatatt

SEQ ID NO: 243 - DNA, 2684 bp, Tomato leaf curl New Delhi virus
accgaatggccgcgcaaatttttaggtgggccctcaaccaatgaaattcacgctacatggcttatttagtgatccattattgcacgaatttccagaaagcgttcatggtctaaggtgcatgctagctgtaaaatatctccaagagatagagaagaactattccccagacacagtcggctacgatcttgtccgagatctcattcttgttctccgagcaaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggaccaacaggccgatgaacagaaaacccagaatgtacagaatgtataggagtcccgacgtgccaaggggctgtgaaggcccttgtaaggtgcagtcttttgaatctaggcacgatgtctctcatattggcaaagtcatgtgcgttagtgatgttactcgaggaactggactcacacatcgcgtggggaagcgattttgtgtgaaatctgtctatgtgctggggaagatatggatggatgaaaacatcaagacaaaaaaccatactaacagtgtcatgttttttttagttcgtgaccgtcgtcctacaggatcccctcaagattttggggaagtttttaacatgtttgacaatgaaccgagcacagcaacggtgaagaacatgcatcgtgatcgttatcaagtcttacggaagtggcatgcgactgtgacgggaggaacatatgcatctaaggagcaagcattagttaggaagtttgttagggttaataattatgttgtttataatcaacaagaggccggcaagtatgagaatcatactgaaaacgcattaatgttgtatatggcctgtactcacgcatcaaatcctgtatatgctactttgaaaatccggatctacttttatgattcggtcacaaattaataaatatccagttttatatcatacgaagtccatacatcaattgttccctccaatacattatccaatacatgataaactgctcttattacattataaattcctatgacacctaacatatccaggtacctaaggacctgggttttgaagactctcaagaaaatcccaatctgagggcgtaagcccgtccagattttgaaagttagaaaacacttgtgaagtcccagggctttccgcaggttgtggttgaattgtatttgaatcttgatgatgtcgtgctgtgttaggaagggcctgctgtcgtgtttcaaaattttgaaatacaggggatttcgaatttcccaggtatatacgccactctctgctcgatccgcagtgatgtactcccctgtgcgtgaatccgtgatcatggcagttgatcgatatataatacgtacacccacacgtcagatcaactcgcctcctgcgaatgctcttcttcttcttctgtgggagcgatgttttcgcgaccggaatagagtggttcttcgagtgtgatgaagactgcattcttgattgcccactgcttcagtgctgcatttttttcttcgtccagatattccttatagctgctgtttggacctttattgcacaggaagatagtgggaataccacctttaatcatgactggctttccgtacttcgtgttgctttgccagtcacgctgggcccccatgaattctttaaagtgctttagatagtggggatcaacgtcatcaatgacgttgtaccaggcatcattgctatacacctttgggctcagatcaagatgtccacataagtaattgtggggtcctaagcaacgagcccacattgttttccctgttctactatccccctctatgactatgcttatgggcctaaaaggccgcgcagcggcacacacaacattgacactggcccaatcgacaagttctggaggaactctgtcgaaggatgaaattgaaaatggagaaacgtaaacctcagaacgaggttgaaaaatgcgatctaaattgcttattaaattgtgaaactgcagaacataatcctttggggctaattcctttaatacttttaatgcatcttctttattccccgtgttaatcgccttagcatatgcgtcgttggctgtctgctgaccaccacgagcagatcgtccatcgatctggaaaacaccccattctagaacgtctccatctttgtcgatgtatgctttgacatctgacgctgatttagctccctgaatgttcggatggaaatgtgctgaccgacttggggaaaccaagtcgaagaatctgttattcttgcactggaatttcccttcgaattggatgagaacatggatatgcggagacccatcctcgtgaagctctctacagatcttgatgaatttcttcgcagttggggtttctagggtttgcaattgggaaagtgcctcttctttagttagagagcactttggatatgtgaggaaatagtttttggcatctattctgaaacgacgtggcggagccataaaacttgtcgttttgattcggcgtccctcaacttcctctatgtaattggcgtctggcgtcccatatataggtaggacgctaaatggcagaattgtaattttgaaaagaaaattactttaattcaaaatcctcatagcggccattcgttaatatt

SEQ ID NO: 244 - DNA, 2739 bp, Tomato leaf curl New Delhi virus
accgaatggccgcgcaaatttttaggtgggccctcaaccaatgaaattcaagctacatggcttatttagtgcgtggggaccaataaataggcttgctcaccaagtttggatccacaaacatgtgggatccattattgcacgaatttccagaaagcgttcatggtctaaggtgcatgctagctgtaaaatatctccaagagatagaaaagaactattccccagacacagtcggctacgatcttgtccgagatctcattcttgttctccgggcaaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcctttgaatctaggcacgatgtctctcatattggcaaagtcatgtgtgttagtgatgttacccgagggactggactcacacatcgcgtagggaagcgattctgtgtgaaatccgtctatgtgctggggaagatatggatggatgaaaacatcaagacaaaaaaccatactaacagtgtcatgttttttttggttcgtgaccgtcgtcctacaggagctccccaagatttcggggaagtgtttaatatgtttgacaatgaacctagcacagcaacggtgaagaacatgcatcgtgatcgttatcaagttttacggaagtggcatgcgactgtgacgggaggaacatatgcatctaaggagcaagcactagttaggaagtttgttagggttaataattatgttgtttataatcaacaagaggccggcaagtatgagaatcatactgaaaacgcattaatgttgtatatggcctgtactcacgcatcaaatcctgtatatgctactttgaaaatccggatctacttttatgattcggtcacaaattaataaatatccagttttatatcatacgaagtccatacatcaattgttcgctctaatacattatccaatacatgataaactgctcttattacattataaattcctatgacacctaacatatccaggtacttaaggacctgggttttgaagactctcaagaaaatcccaatctgagggcgtaagcccgtccagattttgaaagttagaaaacacttgtgaagtcccagggctttccgcaggttgtggttgaactgtatttgaatcttgattatgtcgtgctgtgttaggaagggcctgctgtcgtgtttcaaaattttgaaatacagggatttcgaatttccccaggtatatacgccactctctgctcgatccgcagtgatgtattcccctgtgcgtgaatccgtgatcatggcagttgatcgatatataatacgaacaaccacacggcagatcaactcgcctcctgcgaatgctcttcttcttcttctgggggagcgatgttttcgcgaccggaatagagtggttcttcgagtgtgatgaagactgcattcttgattgcccactgcttcagtgctgcatttttttcttcgtccagaaattccttatagctgctgtttggacctttattgcacaggaagatagtgggaattccacctttaatcatggctggctttccgtacttcgtgttgctttgccagtcacgctgggcccccatgaattctttaaagtgctttagatagtggggatcaacgtcatcaatgacgttgtaccaggcctcattgctatacacttttgggctcagatcaagatgtccacacaagtaattgtggggtcctaagcaccgagcccacattgttttgcccgttctactatccccctctatgactatgcttatgggcctaaaaggccgcgcagcggcacacacaacattggatgagacccaatcgacgagttctggcggaactctgtcgaaggatgaaattgaaaatggagaaacataaacctcggaaggaggttgaaaaatgcgatctaaattggtatttaaattgtggaactgcagaacgtaatcctttggggctaattcctttaatactttcaaagcatcgtctttatttcccgtgttaatcgcctgggcatatgcatcgttcgccgtttgctgaccaccacgggcagatcgtccatcgatctggaaaacaccccattctagaacgtctccgtctttgtcgatgtattttttgacgtccgacgctgatttagctccctgaatgttcggatggaaatgtgctgaccgacttggggaaaccaagtcgaagaatctgttatttttgcactggaatttcccttcgaattggatgagaacatggatatgcggagacccatcttcgtgaagctctctacagatcttgatgaatttcttcttcgttggggtttctagggtttgcaattgggaaagtgcctcttctttagttagagagcactttggatatgtgaggaaatagtttttggcatttactctaaaacgacgtggcgaagccataaaacttgtcgttttgattcggcgtccctcaacttatctatgtaattggtgtctggagtcctatatataggtaagacaccatatggcattattgtaattttgaaaagaaaattactttaattcaaattccctaaagcggccattcgtataatatt

SEQ ID NO: 245 - DNA, 2739 bp, Tomato leaf curl New Delhi virus
accgaatggccgcgcaaatttttaggtgggccctcaaccaatgaaattcacgctacatggcttatttagtgcggggggaccaataaatagacttgctcaccaagtttggatccacaaacatgtgggatccattattgcacgaatttccagaaagcgttcatggtctgaggtgcatgctagctgtaaaatatctccaagagatagaaaagaactattccccagacacagtcggctacgatcttgtccgagatctcattcttgttcttcgggcaaagaactatggcgaagcgaccagcagatatcatcatttcaacgcccgcatcgaaagtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaagggggtgtgaaggcccttctaaggtgcagtcctttgaatctaggcacgatgtctctcatattggcaaagtcatgtgtgttagtgatgttacccgagggactggactcacacatcgcgtagggaagcgattctgtgtgaaatccgtctatgtgctggggaagatatggatggatgaaaacatcaagacaaaaaaccatactaacagtgtcatgttttttttagttcgtgaccgtcgtcctacaggagctccccaggatttcggggaagtttttaatatgtttgacaatgaaccgagcacagcaactgtgaagaacatgcatcgtgatcgctatcaagtcttacggaagtggcatgcgactgtgacgggaggaacatatgcatgtaaggagcaagcattagttaggaagtttgttagggttaataattatgttgtttataatcaacaagaggcaggcaagtatgagaatcatactgaaaacgcattaatgttgtacatggcctgtactcacgcatcaaatcctgtatatgctactttgaaaatccggatctatttctatgattcggtcacaaattaataaatatggagctttatatcatatgaagtccatacatcaatcgttttttctaatacattatcaaatacatgataaactgctcttattacattataaattccaactacaccaagcatatttaggtaccgaaggacctgcgttctaaaaaccctcaagaaaatcccagtcggagggcgtaagcccgtccagatttggaaagttagaaaacacttgtgaagtccaagagctttccgcaggttgtggttgaactgtatctgtactttgattatgtcgtgattggtgaggaatggtcggctgtcgtgtttcagtattttgaaatacaggggatttggaacctcccagataaacacgccactctctgctcgatgcgcagtgatgtactccccggtgcgtgaatccatgatcatggcagttgatcgatatgtaatacgaacaaccacactgcagatcaactcgcctcctgcgtatgctcttcttcttcttctgtgggagcgatgttttcgcgaccggaatagagtggttcttcgagtgtgatgaagactgcattcttgattgcccactgcttcagtgctgcatttttttcttcgtccagatattccttatagctgctgtttggacctttattgcacaggaagatagtgggaatgccacctttaatcatgactggctttccgtacttcgtgttgctttgccagtcacgctgggcccccatgaattctttaaagtgctttagatagtggggatcaacgtcatcaacgacgttgtaccaggcctcattgctatacacttttgggctcagatcaagatgtccacacaagtaattgtggggtcctaagcaacgagcccacattgttttgcctgttctactatccccctctatgactatgcttatgggcctaaaaggccgcgcagcggcacacaccacattggacgatacccaatcgacgagttctggcggaactctgtcgaaggaagaaattgaaaatggagaaacataaacctcagaaggaggttgaaaaatgcgatctaaattggtatttaaattgtgaaactgcagaacaaaatcctttggggctaattcctttaatactttcaacgcatcgtctttatttcccgtgttaatcgcctgagcatatgcatcgtttgccgtttgttgaccaccacgagcagatcgtccatcgatctggaaaacaccccattctagaacgtctccgtctttgtcgatgtactttttgacgtccgatgccgatttagctccctgaatgttcggatggaaatgtgctgaccgacttggggaaaccaagtcgaagaatctgttatttttgcactggaattttccttcgaattggatgagaacatggatatgcggagacccatcctcgtgaagctctctacagatcttgatgaatttcttcctggttggggtttctagggtttgcaattgggaaagtgcctcttctttcgttagagagcactttggatatgtgaggaaatagttttttgcatttactctaaaatgacgtggcgaagccataaaacttgtcgttttgattcggcgtccctcaacttatctatgtaattggtgtctggagtcctatatataggtaagacaccatatggcataattgtaattttgaaaagaaaattactttaattcaaattccctaaagcggccattcgtataatatt

SEQ ID NO: 246 - DNA, 2740 bp, Tomato leaf curl New Delhi virus
accgaatggccgcgcaaatttttaggtgggccctcaaccaatgaaattcacgctacatggcttatttagtgcgtggggaccaataaatagacttgctcaccaagtttggatccacaaacatgtgggatccattattgcacgaatttccagaaagcgttcatggtctgaggtgcatgctagctgtaaaatatctccaagagatagaaaagaactattccccagacacagtcggctacgatcttgtccgagatctcattcttgttcttcgggcaaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcttttgaatctaggcacgatgtatctcatattggcaaagtcatgtgtgttagtgatgttacccgagggactggactcacacatcgcgtagggaagcgattctgtgtgaaatccgtgtatgtgctggggaagatatggatggatgaaaacatcaagacaaaaaaccatactaacagtgtcatgttttttttagttcgtgaccgtcgtcctacaggagctccccaggatttcggggaagtttttaatatgtttgacaatgaaccgagcacagcaacggtgaagaacatgcatcgtgatcgttatcaagtcttacggaagtggcatgcgactgtgacgggaggaacatatgcatgtaaggagcaagcattagttaggaagtttgttagggttaataattatgttgtttataatcaacaagaggccggcaagtatgagaatcatactgaaaacgcattaatgttgtatatggcctgtactcacgcatcaaatcctgtatatgctactttgaaaatccggatctatttctatgattcggtcacaaattaataaatatcgagctttatatcatatgaagtccatacatcaattgttttttctaatacattgtccaatacatgataaactgctcttattacattataaattccaactacacccagcatatttaggtaccgaaggacctgcgttctaaaaaccctcaagaaaatcccagtcggagggcgtaagcccgtccagatttggaaagttagaaaacacttgtgaagtcccagagctttccgcaggttgtggttgaactgtatctgtactttgattatgtcgtggttggtgaggaatggtcggctgtcgtgtttcaatattttgaaatacaggggatttggaacctcccagataaagacgccactctctgcttgatgcgcggtgaagtactccccggtgcgtgaatccatgatcatggcagttgatcgatatgtaatacgaacaaccacactgcagatcaactcgcctcctgcgtatgttcttcttcttcttctgtgggagcgatgttttcgcgaccggaatagagtggttcttcgagtgtgatgaagactgcattcttgattgcccactgcttcagtgctgcgtttttttcttcgtccagatattccttataactgctgtttggacctttattgcacaggaagatagtgggaatgccacctttaatcatgactggctttccgtacttggtgttgctttgccagtcacgctgggcccccatgaattctttaaaatgctttagatagtggggatcaacgtcatcaatgacgttgtaccaggcatcattgctatatacttttgggctcagatcaagatgtccacacaagtaattgtggggtcctaaacaacgagcccacattgttttgcccgttctactatccccctctatgactatgcttatgggccttaaaggccgcgcagcggcacacaccacattggacgacacccaatcgacgagttctggcggaactctgtcgaaggaagaaatagaaaatggagaaacataaacctcagaacgaggttgaaaaatgcgatctaaatttgtaactaaattgtgaaactgcaaaacgtaatcctttggtgctaattctttcaatacttttaacgcatcctctttgtttcctgtgttaattgcctgagcatatgcatcgtttgccgtctgttgacctccacgagcagatcgtccatcgatctggaaaacaccccattctagaacatctccgtctttgtcgatgtatttcttgacatctgacgctgatttagctccctgaatgtttggatggaaatgtgctgaccgacttggggacaccaagtcgaagaatctgttgtttttgcactggaacttcccttcgaactggatgagaacatggatatgcggagacccatcctcgtgaagctctcgacagatcttgatgaatttcttcgtagttggggtttctagggtttgcaattgggaaagtgcctcttcctttgtaagagagcactttggatatgttaggaaatagttttttgcatttattctaaaacgacttggcggagccataaaccttgtcgtttcgatctggtgtctctcaactttgtctatgtaattggtgtctggagtcctatatataggtaagacaccatatggcagaattgtaatttttacaataaaattactttaattcaaattccctaaagcggccattcgtataatatt

SEQ ID NO: 247 - DNA, 2739 bp, Tomato leaf curl New Delhi virus
accgaatggccgcgcaaatttttaggtgggccctcgaccaatgaaatgcacgttacatgtcctatttagtgcgtggggatcaataaatagacttgctcaccaagtttggatccacaaacatgtgggatccattattgcacgaatttccagaaagcgttcatggtctaaggtgcatgctagctgtaaaatatctccaagagatagaaaagaactattcaccagacacagtcggctacgatcttgtccgagatctcattcttgttctccgagcgaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcctttgaatctaggcacgatgtctctcatattggcaaagtcatgtgtgttagtgatgttacccgaggaactggactcacacatcgcgtagggaagcgattctgtgtgaaatccgtctatgtgctgggaaagatatggatggatgaaaacatcaagacaaaaaaccatactaacagtgtcatgtttttcttggtccgtgaccgtcgtcctacaggaactccccaggatttcggggaagtttttaacatgtttgacaatgaaccgagcacagcaacggtgaagaacatgcatcgtgatcgttatcaagtcttacgcaagtggcatgcgactgtgacgggaggaacatatgcatcgaaggagcaagcattagttaggaagtttgttagggttaataattatgtagtttacaatcaacaagaggccggcaagtatgagaatcatactgaaaacgcattaatgttgtatatggcctgtactcacgcatcaaatcctgtatatgctactttgaaaatccggatctacttttatgattcggtcacaaattaataaatatccagttttatatcatatgaagtccatacatcaattgttcgctctaatacattatccaatacatgataaaccgctcttattacattataaattcctatgacacctaacatatccaggtacttaaggacctgggttttgaagactctcaagaaaatcccaatctgagggcgtaagcccgtccagatgttgaaagttagaaaacacttgtgaagtcccagggctttccgcaggttgtggttgaactgtatttgaatcttgattatgtcgtgctgtgttaggaagggcctgctgtcgtgtttcaaaattttgaaatacaggggatttcgaatttcccaggtatatacgccactctctgctcgatccgcagtgatgtattcccctgtgcgtgaatccgtgatcatggcagttgatcgatatataataggaacaaccacacggcagatcaactcgcctcctgcgaatgctcttcttcttcttctgggggagcgatgttctcgcgaccggaatagagtggttcttcgagtgtgatgaagactgcattcttgattgcccactgcttcagtgctgcatttttctcttcgtccagatattccttatagctgctgtttggacctttattgcacaggaagatagtgggaattccacctttaatcatgactggctttccgtacttcgtgttgctttgccagtcacgctgggcccccatgaattctttaaaatgctttagatagtggggatcaacgtcatcaatgacgttgtaccaggcttcattgctatacacttttgggctcagatcaagatgtccacacaagtaattgtggggtcctaagcaacgagcccacattgttttgccagttctactatccccctctatgactatgcttatgggcctaaaaggccgcgcagcggcacacacaacattggacgagacccaatcgacgaggtctgccggaactctgtcgaaggatgaaattgaaaatggagaaacataaacctcggaaggaggttgaaaaatgcgatctaaatttgtatttaaattgtgaaactgcagaacgaaatcctttggggctaattcctttaatactttcaacgcatcgtctttatttcccgtgttaatcgcctgggcatatgcatcgttcgccgtttgttgacctccacgggcagatcgtccatcgatctggaaaacaccccattctagaacgtctccgtctttgtcgatgtattttttgacgtccgacgctgatttagctccctgaatgttcggatggaaatgtgctgaccgacttggggaaaccaagtcgaagaatctattatttttgcactggaatttcccttcgaattggatgagaacatggatatgcggagacccatcttcgtgaagctctctacagatcttgatgaatttcttcctcgtcggggtttctagggtttgcaattgggaaagtgcctcttctttagttagagagcactttggatatgtgaggaaatagtttttggcatttactctaaaacgacgtggcgaagccataaaacttgtcgttttgattcggcgtccctcaacttatctatgtaattggtgtctggagtcctatatataggtaagacaccatatggcattattgtaattttgaaaagaaaattactttaattcaaattccctaaagcggccattcgtataatatt

SEQ ID NO: 248 - DNA, 2740 bp, Tomato leaf curl New Delhi virus
accgaatggccgcgcaaatttttaggtgggacctcaaccaatgaaattcgggctacatggcttctataatgcatatggagcaataaatagacttgctcaccaagtttggatccacaaacatgtgggatccattattgcacgaatttccagaaagcgttcatggtctaaggtgcatgctagctgtaaaatatcttcaagagatagagaagaactattccccagacacagtcggttacgatcttgtccgagatctgattcttgttcttcgagcaaagaactatgtcgaagcgaccagcagatatcgtcatttcaacgcccgcatcgaaagtacgccgacgtctcaacttcgacagcccctatggagctcgtgcagttgtccccattgcccgcgtcacaaaagcaaagtcatggaccaacaggccgatgaacagaaaacccagaatgtacagaatgtatagaagtcccgacgtgccaaggggctgtgaaggcccctgcaaagtgcagtcttttgaatcgaggcacgatgtatctcatatcggtaaagttatgtgtgttagtgatgttacccgaggaaccggactcacacatcgcgtagggaagcgattttgtgtgaaatctgtctatctgcagggaaagatttggatggatgaaaacatcaagacgaaaaaccatactaatagtgtcatgttttttttagttcgtgaccgtcgtcctacaggaacccctcaagatttcggggaagtgtttaatatgtttgacaatgaaccgagcacagcaacggtgaagaacatgcatcgtgatcgttatcaagtcttacggaagtggcatgcaactgtgaccggaggaacatacgcatctagggagcaagcattagttaggaagtttgttagggttaataattatgttgtttataatcaacaagaggccggcaagtatgagaatcatactgaaaacgcattaatgttgtatatggcctgtactcacgcatcaaatcctgtgtatgctactttgaaaatccggatctacttttatgattcggtcacaaattaataaatatctagttttatatcatatgaagtccatacatcaattgttcgctccaatacattatccaatacatgataaactgctcttattacattataaattcctatgacacctaacatatccaggtacttaaggacctgggttttgaagactctcaagaaaatcccaatctgagggcgtaagcccgtccagattttgaaagttagaaaacacttgtgaagtcccagggctttccgcaggttgtggttgaactgtatttgaatcttgattatgtcgtgctgtgttaggaagggccggctgtcgtgtttcaaaattttgaaatacaggggatttcgaatttcccaggtatatacgccactctctgctcgatccacagtgatgtattcccctgtgcgtgaatccgtgatcatggcagttgatcgatgtgtaatacgaacaaccacacggtagatcaactcgcctcctgcgaatgctcttcttcttcttctgggggagcgatgatttcgcgaccggaatagagtggttcctcgagtgtgatgaagactgcattcttgattgtccactgcttcagtgctgcatttttttcttcatccagatattccttatagctgctgtttggacctttattgcacaggaagatagtgggaattccacctttaatcatgaccggctttccgtacttcgtattgctttgccagtcacgctgggcccccatgaattctttaaaatgctttagatagtggggatcgacgtcatcaatgacgttgtaccatgcatcattgctatacacctttgggctcagatctagatgtccacacaagtaattgtgtggtcctaagcaacgagcccacattgttttgcccgtcctactatccccctctatgactacacttattggtctaaaaggccgcgcagcggcacacactacattcgacgagacccaatcgacgagttctggcggaactctgtcgaaggataaaattgaaaatggagaaacataaatctcggaacgaggttgaaaaatgcgatctaaatttgtaattaaattgtgaaactgcagaacataatcctttggtgcaaattcctttaatactttcaaggcatcatctttatttcctgtgttaatcgcctgagcatatgcatcgtttgctgttttctgaccaccacgagcagatcgtccatcgatctggaaaacaccccactctacgacgtctccgtctttgtcgatgtacgctttgacgtccgatgctgatttagctccctgaatgttcggatggaaatgtgctgaccgacttggggacaccaagtcgaagaatctgttattcttgcattggaattttccctcgaattggataagaacatggatatgcggtgacccatcctcatgaagctctggacagatcttgatgaatttcttcgaagtgggggtttctagggtttgcaattgggaaagtgcctcttcctttgtaagagagcactttggatatgtgaggaagtagttttttgcatttattctaaaacgacttggcggagccataaaacttgtcgtttcgatccggtgtctctcaactttctctatgtaattggtgtctggagtcccatatataggtaagacaccatatggcataattgtaatttcagaaaagaaattactttaattcaaattcactaaagcggccattcgtataatatt

SEQ ID NO: 249 - DNA, 2739 bp, Tomato leaf curl New Delhi virus
accgaatggccgcgcaattttttaggtgggccctcaaccaatgaaattcgagctacatggcttctttgctgcgtggggaccaataaatagacttactcaccaagtttggatccacaaacatgtgggatccattattgcacgaatttccagaaagcgttcatggtctaaggtgcatgctagctgtaaaatatctccaagagatagaaaagaactattctccagacacagtcggctacgatcttgtccgagatatcattcttgttcttcgagcaaagaactatggtgaagcgaccagcagatatcatcttttcaacgcccgtttcgaaagtacgccgacgtctcaacttcgacagcccctttggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgtaaggtgcagtcctttgaatctaggcacgatgtctctcatattggcaaagtcatgtgtgttagtgatgttacccgaggatctggactcacacatcgcgtagggaagcgattttgtgtgaaatctgtctatgtgctggggaagatatggatggatgaaaacatcaagacaaaaaaccatactaacagtgtcatgttttttttggtccgtgaccgtcgtcctacaggatctccacaagattttggggaagtttttaacatgtttgacaatgaaccgagcacagcaacggtgaagaacatgcatcgtgatcgttatcaagtcttacggaagtggcatgctactgtgacgggaggaacatatgcatctaaggagcaagcattagttaggaagtttgttagggttaataattatgttgtctataaccaacaagaggccggcaagtatgagaatcatactgagaacgcattaatgttgtatatggcctgtactcatgcatcaaatcctgtgtatgctactttgaaaatccggatctatttctatgattcggtaacaaattaataaatatcgagttttatatcatatgaagtccatacatcaatcgtttgttccattacattatccaaaacatgataaactgctcttattacattataaattcctattacaccaagcctatccaggtacctaaggacctgtgttttgaagactctcaagaaaatcccaatctgagggcgtaagcccgtccagattttgaaagttagaaaacacttgtgaagtcccagggctttccgcaggttgtggttgaattgtatttgaatattgatgatgtcgtgctgtcttaggaagggtctgctgttgtgtttcaaaattttgaaatacaggggatttcgaatttcccaggtatatacgccactctctgctcgatccgcagtgatggactcccctgtgcgtgaatccgtgatcatggcagtggatcgatatgtaatacgtacacccacactgcagatcaactcgcctcctgcgaatgctcttcttcttcttctgtgggagcgatgttttcgcgaccggaatagagtggttcttcgagtgtgataaagactgcattcttgattgcccactgcttcagtgctgcgtttttttcttcgtccagatattccttatagctggtgtttggacctttattgcacaggaagatagtgggaattccacctttaatcatgactggctttccgtacttcgtgttgctttgccagtcacgctgggcccccatgaattctttaaaatgctttagatagtgtggatcaacgtcatcaatgacgttgtaccaggcctcattgctatacacctttgggctcagatcaagatgtccacataagtaattatggggtcctaagcaacgagcccacattgttttgcccgttctactatccccctctatgactatgcttatgggcctgaaaggccgcgcagcggcacacaccacattggacgacacccaatcgacgagttctggcggaactctgtcgaaggatgaaattgaaaatggagaaacataaatctcagaaggaggttgaaaaatgcgatctaaattggtatttaaattgtgaaactgcagaacataatcctttggggctaattcctttaatactttcaacgcatcgtctttatttcccgtgttaatcgcctgagcatatgcatcgttcgccgtttgttgacctccacgagcagatcgtccatcgatctggaaaacaccccattctagaacgtctccgtctttgtcgatgtactttttgacgtccgatgctgatttagctccctgaatgttcggatggaaatgtgctgaccgacttggggaaaccaagtcgaagaatctgttatttttgcactggaatttgccttcgaattggatgagaacatggatatgcggagacccatcctcgtgaagctctctacaaatcttaatgaattttttcgcagttggggtttctagggtttgcagttgggaaagtgcgtcctccttagttagagagcactttggatatgtgaggaaatagtttttggcatttattctaaaacgacgtggtggagtcataaaacttgtcgttttgattcggcgtccctcaacttgctctatgtaattggtgtctggagtcccatatataggtaagacaccatatggcagaattgtaattttgaaaagaaaattactttaattcaaattcctaaagcggccattcatctaatatt

SEQ ID NO: 250 - DNA, 2740 bp, Tomato leaf curl New Delhi virus
accgaatggccgcgcaaatttttaagtgggtcctcaaccaatgaaattcgagctacatggcttctttgctgcgtggggaccaataaatagacttactcaccaagtttggatccacaaacatgtgggatccattattgcacgaatttccagaaagcgttcatggtctaaggtgcatgttagctgtaaaatatctccaagagatagaaaagaactattccccagacacagtcggctacgatcttgtccgagatctcattcttgttcttcgagcaaagaactatggtgaagcgaccagcagatatcatcttttcaacgcccgtatcgaaagtacgccgacgtctcaacttcgacagcccctttggagctcgtgcagttgtccccattgcccgcgtcacaaaagcaaaggcctggaccaacaggccgatgaacagaaaacccagaatgtacagaatgtatagtagtcccgacgtgccaaggggctgtgaaggcccttgtaaggtgcagtcctttgaatctaggcacgatgtctctcatattggcaaagtcatgtgtgttagtgatgttacccgaggatctggactcacacatcgcgtagggaagcgattttgtgtgaaatctgtctatgtgctggggaagatatggatggatgaaaacatcaagacaaaaaaccatactaacagtgtcatgttttttttggtccgtgaccgtcgtcctacaggatctccacgagattttggggaagtttttaacatgtttgacaatgaaccgagcacagcaacggtgaagaacatgcatcgtgatcgttatcaagtcttacggaagtggcatgctactgtgacgggaggaacatatgcatctaaggagcaagcattagttaggaagtttgttagggttaataattatgttgtctataaccaacaagaggccggcaagtatgagaatcatactgagagcgcattaatgttgtatatggcctgtactcatgcatcaaatcctgtgtatgctactttgaaaatccggatctatttctatgattcggtaacaaattaataaatatcgagttttatatcatatgaagtccatacatcaatcgtttgttccattacattatccaaaacatgataaactgctcttattacattataaattcctattacaccaagcctatccaggtacctaaggacctgtgttttgaagactctcaagaaaatcccaatctgagggcgtaagcccgtccagattttgaaagttagaaaacacttgtgaagtcccagggctttccgcaggttgtggttgaattatatttgaatactgatgatgtcgtgctgtcttaggaagggtctgctgttgtgtttcaaaattttgaaatacaggggatttcgaatttcccaggtatatacgccactctctgctcgatccgcagtgatggactcccctgtgcgtgaatccgtgatcatggtagtttatggatatgtaatacgtacacccacactgcagatcaactcgcctcctgcgaatgctcttcttcttcttctgtgggagtgatgttttcgcgaccggaatagagtggttcttcgagtgtgataaagactgcattcttgattgcccactgcttcagtgctgcgtttttttcttcgtccagatattccttatagctggtgtttggacctttattgcacaggaagatagtgggaattccacctttaatcatgactggctttccgtacttcgtgttgctttgccagtcacgctgggcccccatgaattctttaaaatgctttagatagtgtggatcaacgtcatcaatgacgttgtaccaggcctcattgctatagacctttgggctcagatcaagatgtccacacaagtaattgtggggtcctaaacaacgagcccacattgttttgcccgttctactatccccctctatgactatgcttatgggcctgaaaggccgcgcagcggcacacaccacattggacgagacccaatcgacgagttctggcggaactctgtcgaaggatgaaattgaaaatggagaaacataaatctcagaaggaggttgaaaaatgcgatctaaattggtgtttaaattgtgaaactgcagaacataatcctttggggctaattcctttagtaccttcaacgcatcgtctttatttcccgtgttaatcgcctgagcatatgcatcgttcgccgtttgttgaccaccacgagcagatcgtccatcgatctggaaaacaccccattctagaacgtctccatctttgtcgatgtactgtttgacgtccgatgctgatttagctccctgaatgttcggatggaaatgtgctgaccgacttggggaaaccaagtcgaagaatctgttatttttgcactggaatttcccttcgaattggatgagaacatggatatgcggagacccatcctcgtgaagctctctacagatcttaatgaattttttcgcagttggggtttctagggtttgcagttgggaaagtgcgtcctccttagttagagagcacttcggatatgtgaggaaatagtttttggcatttattctaaaacgacgtggcggagccataaaacttgtcgttttgatccggcgtccctcatcttcttctatgtaattggtgtctggagtcccatatataggtaagacaccatatggcagaattgtaattttgaaaagaaaattactttaattcaaattccctaaagcggccattcgtataatatt

SEQ ID NO: 251 - DNA, 1776 bp, Tomato leaf curl New Delhi virus
taatattaccgaatggccgcgcaaattttttggtgggccctcaaccaatgaaattcacgctacatggcctatttagtgcgtggggaccaataaatagacttgctcaccaagtttggatccacaaacatgtgggatccattgttgcacgaatttccagaaagcgttcatggtctaaggtgcatgctagcagtaaaatatctccaagagatagaaaagaactattccccagacacagtcggctacgatcttgtccgagatctcattcttgttctccgagcaaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggctgtgaaggcccttgcaaggtgcagtcctttgaatctaggcacgatgtctctcatattggcaaagtcatgtgtgttagtgatgttactcgaggaactggactcacacatcgcgaagggaagcgattttgtgtgaaatctgtctatgtgctggggaagatatggatggatgaaaacatcaagacaaaaaaccatcctaacagtgtcatgttttttctggtccgtgaccgtcgtcctacaggatcccctcaagattttggggaagtttttaacatgtttgacaatgaaccgagcacagcaacggtgaagaacatgcatcgtgatcgttatcaagtcttacggaaatggcatgcgactgtgacgggaggaacatatgcatctagggagcaagcattagttaggaagtttgttagggttaataattatgtagtttacaatcaacaagaggccggcaagtatgagaatcatactgaaaatgcattaatgttgtatatggcctgtactcatgcatcaaatcctgtttatgctactttgaaaatccggatctatttctatgattcggtaacaaattaataaatatccagctttatatcatatgaagtctgtacatcaatcgtttgttccattacattatccaaaacatgataaactgctcttattacattataaattcctattacaccaagcatatccaggtacctaaggacctgggttttgaagactctcaagaaaatcccaatctgagggcgtaagcccgtccagattttgaaagttagaaaacacttgtgaagtcccagggctttccgcaggttgtggttgaattgtatttgaatcttgatgatgtcgtgctgtgttaggaagggcctgctgtcgtgcttcaaaattttgaaatacaggggatttcgagtttcccaggtatatacgccactctctgctcgatccgcagtgatgtattcccctgtgcgtgaatccgtgatcatggcagttgatcgatatataatatgtacacccacacggaagatcaactcgcctcctgcgaatgctcttcttcttcttctgggggagcgatgttttcgcgaccggaatagagtggttcttcgagtgtgatgaagactgcattcttgattgcccactgcttcagtgctgcatccttctcttcgtccagatattccttatagctgctgtttggacctttattgcacaggaagatagtgggaattccacctttaatcatgaccggctttccgtacttcgtgttgctttgccagtctttctgggcccccataatcact

SEQ ID NO: 252 - DNA, 2740 bp, Tomato leaf curl New Delhi virus
accgaatggccgcgcaaatttttatgtgggaccgcgacgaatgaaattcaagctacatggcttctttaatgcgtagggacctttaaatagacttgctcaccaagtttggatccacaaacatgtgggatccattattgcacgaatttccagaaagcgttcatggtctaaggtgcatgctagctgtaaaatatctccaagagattgaaaagaactactccccagacacagtcggatacgatcttgtccgagatctcatccttgttctccgagcaaagaactatggcgaagcgaccagcagatatcatcatttcaacgcccgcatcgaaggtacgccgacgtctcaacttcgacagcccctatggagctcgtgcagttgtccccattgcccgcgtcacaaaagcaaaggcctggacaaacaggccgatgaacagaaaacccagaatgtacagaatgtatagaagtcccgacgtgccaaggggatgtgaaggcccttgcaaggtgcagtcctttgaatccaggcacgatgtctctcatattggcaaggtcatgtgcgttagtgatgttactcgaggaactggactcacacatcgcgtaggaaagcgattttgtgtgaaatctgtgtatgtgctggggaagatatggatggatgaaaacaccaagacgaaaaaccatactaacagtgttatgttttttttggtccgtgaccgtcgtccgacgggatccccccaagattttggggaagtttttaacatgtttgacaatgaaccgagcacagcaacggtgaagaacatgcatcgtgatcgttatcaagtgttacggaagtggcatgcgactgtgacgggaggaacttatgcatcgaaggagcaagcattagttaggaagcttgttagggttaataattatgttgtttataatcaacaagaggccggcaagtatgagaatcatactgaaaatgcgttaatgttgtatatggcctgtactcacgcatcaaatcctgtatatgctactttgaaaatccggatctatttctatgattcggtcacaaattaataaatatcgagttttatatcatatgaagtccatacatcaatcgtctgttccaatacattatccaatacatgataaactgctcgtattacattataaattcctatgacacctaacatatccaggtacttaaggacctgggttttgaagactctcaagaaaatcccaatctgagggcgtaagcccgtccagatttggaaagttagaaaacacttgtgaagccccagtgctttccgcaggttgtggttgaattgtatttgaactttgattatgtcgtgctgtgttaggaagggcctgctgtcgtgtttcaaaattttgaaatagaggggatttcgaatttcccaggtatatacgccactctctgctcgatccgcagtgatgtattcccctgtgcgtgaatccgtgatcatggcagtttatcgacacgtaatacgaacaaccacacggaagatcaactcgcctcctgcgaatgctcttcttcttcttctgcgggagcgatgttttcgcgaccggaatagagtggttctttgagtgtgatgaagactgcattcttgattgcccactgcttcaatgctgcattcttctcttcgtccaaatattccttatagctgctgtttggacctttattgcagaggaagatagtgggaattccacctttaatcatgaccggctttccgtacttcgtgttgctttgccagtcacgctgggcccccatgaattctttaaagtgctttagatagtggggatcaacgtcatcaatgacgttgtaccaagcatcattgctatacacctttgggctgagatctagatgtccacacaagtaattgtgtggtcctaagcaacgagcccacattgttttgcccgtcctactatccccctctatgactacacttattggcctaaaaggccgcgcagcggcacacacaacattcgacgtgacccaatcgacgagttctggcggaactctgtcgaaggaagaaattgaaaatggagagacataaacctcagaacgtgtttgaaaaatgcgatctaaatttgtaatcaaattgtgaaactgcagaacataatcctttggtgcaagttctttcaataatttcatggcatcttctttatttcctgtgtttatcgcctgagcatatgcatcgtttgctgtttgctgaccaccacgagcagatcgtccatcgatctggaaaacaccccattctagaacgtctccatctttgtcgatgtatgctttgacgtccgatgctgatttagctccctgaatgttcggatggaaatgtgctgaccgacttggggacaccaagtcgaagaatctgttatttttgcattggaattttccttcgaattggataagaacatggatatgcggagtcccatcttcgtgaagctctcgacagatcttgatgaatttcttcgaagttggggtttctagggtttgtaattgggaaagtgcctcttccttcgtaagagagcactttggatacgtgaggaaatagtttttcgcatttattctaaaacgacttggcggagccataaaacattgtcgtttcgatccggtgtctctcaacttttctatgtaattggtgtctggagtcccatatataggtaagacaccatatggcagaattgtaattttgagaagaaaattactttaattcaaaatccctaaagcggccattcgtataatatt

SEQ ID NO: 253 - DNA, 2738 bp, Tomato leaf curl New Delhi virus
accgaatggccgcgaaaattttggtgggccctcaaccaacgaaatgcaagctacatggcttatttagtgcggggggaccattaaatagccttgctgacgaagtttaggtccacaaacatgtgggatccattattgcacgaatttcctgaaagcgtgcatggtctaaggtgcatgctagctgtaaaatatcttcaagagatagagaagaactattccccagacacagtgggctacgatcttgtccgagatctaattttagtagttcgagcaaagaactatgtcgaagcgaccagcagatatcatcatttcaactcccgcatcgaaggtacgccgacgtctcaacttcgacagcccttatggagctcgtgcagttgtccccattgcccgcgtcacaaaagcaaaggcgtggacaaacaggccgatgaacagaaagcccagaatgtatagaatgtacagaagccccgacgtgccaaggggatgtgaaggtccttgtaaggtgcagtcttttgaatctaggcacgatgtgtctcatattggcaaagtcatgtgtgtcagtgacgttacccgaggaaccggactgactcatcgcgtggggaagcgtttctgtgtgaaatctgtgtatgtattggggaagatatggatggatgaaaacataaagactaaaaaccacacgaacagtgtgatgtttttcttggttcgtgaccgtcgtcctacgggatcgccacaggattttggtgaagtgttcaacatgtttgacaatgaaccgagcaccgcaacggtgaagaacatgcatcgtgatcgttatcaagtgttaaggaaatggcatgcgactgtgactggagggacttatgcatcgaaggagcaagcattagttaggaagtttgttagggttaataattatgtcgtttataatcaacaagaggccggaaagtatgaaaatcatactgagaacgcattaatgttgtatatggcctgtactcatgcatcaaatcctgtgtatgctactttgaaaatccggatctatttttatgattcggtaacaaattaatatatattaatccttacatcacatgatggcaatacatcaatagtcttttctaaaacattatccaatacatgataggctgctcttattacattcgaaattcctattacaccaagctcatggaggtatttaaggacctgtgtcttaaataccctcaagaaaatcccagtcggagggcgtaagcccgtccagatttggaaaattagaaaacacttgtgaagccccagagctttccgcaggttgtggttgaactgtatttggaggtggatgatgtcgtgattcgtgaggcatggtctgctgtcgtgtttcaatattttgaaatacaggggatttggaacgtcccaaataaacacgccactctctactcgatccgcagtgatgtactcccctgtgcgtgaatccgtgatcatgacagttgattgatatgtagtacgaacaaccacactgcagatcaactcgcctcctgcgtatgttcttcttcttcttctgggggactgatgttttcgcgaccggaatagagtggttcttggagtgtgacgaagactgcattcttgatagcccactgtttcagtgatgcatttttttcttcgtcgagatattccttatagctgctgtttggtcctttattgcagaggaagatggtgggaataccgcctttaatcatgaccggctttccgtacttcgtattgctttgccagtcacgctgggcccccatgaattctttaaagtgctttagatagtggggatcgacgtcatcaatgacgttgtaccacgcttcattattgtacactttcgggctgagatccagatgaccacacaagtaattgtggggtcctagtgaacgtgcccacattgtctttcccgttctactatccccctctattactacgcttattggtctaaaaggccgcgcagcggcagacaatacattggactgaacccaatcgacgagttctggaggaactgtgtcgaaggaagtagttgagaatggagatacatagacctcagaacgtggttgaaaaatgcgatctaaattcgtcattaaattatggaactgcagaacataatcttttggtgctagttcttttagtactttcaatgcatcttctttgtttccggtgttaattgcctgagcgtatgcatcgtttgccgtctgttgacccccacgagcagatcgtccgtcgatctggaaaacaccccattctagcacgtctccgtctttgtcgatatatgccttgacgtcggacgccgatttagctccctgaatgttcggatggaaatgtgctgaccgagttggggataccaagtcgaagaatctgttattcttgcactggtatttcccttcgaattgaatgagaacatggatatgcggagacccatcctcgtgactctctctacagattttgatgaatttcttgcaagtaggggtttctaggtttattaattgggaaagtgcctcttcctttgtaagagagcattttgggtaagtgaggaaatagtttttggcattaattctaaaacgacttggcggagccatataaaatgtcgtttcgatccggtgtctctcaactttctctatgtaattggtgtctggagtcccatatatagttaggacaccatatggcactattgtaatttctgaaagtaaattactttaattcaaattgcgtaaagcggccattcgtataatatt

SEQ ID NO: 254 - DNA, 2740 bp, Tomato leaf curl New Delhi virus
taatattaccgaatggccgcgcaaatttttaggtgggccctcaaccaatgaaattcacgctacatggcttatttagtgcggggggaccaataaatagacttgctcaccaagtttggatccacaaacatgtgggatccattattgcacgaatttccagaaagcgttcatggtctaaggtgcatgctagctgtaaaatatctccaagagatagaaaagaactattccccagacacagtcggctacgatcttgtccgagatctcattcttgtcctccgagcaaagaactatggcgaagcgaccagcagatatcatcatttcaacgcccgcatcgaaagtacgccgacgtctcaacttcgacagcccctatggagctcgtgcagttgtccccattgcccgcgtcacaaaagcaaaggcctggaccaacaggccgatgaacagaaaacccagaatgtacagaatgtatagaagtcccgacgtgccaaggggatgtgaaggcccttgcaaggtgcagtcctttgaatctaggcacgatgtttctcatattggcaaagtcatgtgcgttagtgatgttactcgaggaactggactcacacatcgcgtaggaaagcgattttgtgtgaaatctgtctatgttctggggaagatatggatggatgaaaacatcaagacgaaaaaccatactaacagtgttatgttttttttggtccgtgaccgtcgtcctacaggatccccccaagattttggggaagtttttaacatgtttgacaatgaaccgagcacagctacggtgaaaaacatgcatcgcgatcgttatcaagtcttacggaaatggcatgcgactgtgacgggaggaacttatgcatctaaggagcaagcattagttaggaagtttgttagggttaataattatgttgtttacaatcaacaagaggccggcaagtatgagaatcatactgaaaatgcattaatgttgtatatggcctgtactcatgcatcaaatcctgtatatgctactttgaaaatccggatctacttttatgattcggtcacaaattaataaatatccagttttatatcatatgaagtccatacatcaatcgttcgctccaatacattatctaatacatgataaactgctcttactacattatatattcctattacacctaacatatccaggtacttaaggacctgggttttgaagactctcaagaaaatcccaatctgagggcgtaagccgtgccagattttgaaagttagaaaacacttgtgaagtcccagggctttccgcaggttgtggttgaattgtatttgaatcttgatgatgtcgtgctgtgttaggaagggcctgctgtggtgttgcaaaattttgaaatacaggggatttcgaatttcccaggtatatacgccactctctgctcgatccgcagtgatgtattcccctgtgcgtgaatccgtgatcatggcagttgatcgatatataatacgaacaaccacacggcagatcaactcgcctcctgcgaatgctcttcttcttcttctgtgggagcgatgttttcgcgaccggaatagagtggttcttcgagtgtgatgaagactgcattcttgattgcccactgcttcagtgctgcatttttttcttcgtccagatattccttatagctgctgtttggacctttattgcacaggaagatagtgggaattcctcctttaatcatgactggctttccgtattttgtgttgctttgccagtcacgctgggcccccatgaattctttaaagtgctttagatagtggggatcaacgtcatcaatgacgttgtaccaggcatcattgctatacacctttgggctcagatcaagatgtccacacaagtaattgtggggtcctaagcatcgagcccacattgttttgcccgttctactatccccctctatgactatgcttatgggcctaaaaggccgcgcagcggcacacacaacattggacgagacccaatcgacgagttctgccggaactctgtcgaaggatgaaatagaaaatggagaaacataaacctcagaacgaggttgaaaaatgcgatctaaatttgtaactaaattatgaaactgcagaacgtaatcctttggtgctaattctttcaatactttcaacgcatcctctttatttcctgtgttaattgcctgagcatatgcatcgtttgccgtctgttgacctccacgagcagatcgtccatcgatctggaaaacaccccattctagaacgtctccgtctttgtcgatatacttcttgacatctgacgctgatttagctccctgaatgttcggatggaaatgtgctgcccgacttggggaaaccaagtcacagaatctgttatttttgcactggaatttaccttcgaattggatgagaacgtggatatgcggagacccatcctcgtgaagctctctacagatcttgatgaatttcttcgcagttggggtttctagggtttgcaattgggaaagtgcctcttctttagttagagagcacttcggatatgtgaggaaatagtttttggcatctatcctaaaacgacgtggcggagccatcaaacttgtcgttttgattcagcgtccctcaacttcctctatgtaattggcgtctggcgtcccatatataggtaggacgctaaatggcagaattgtaattttgaaaagaaaattactttaattcaaaatcctcatagcggccattcgtt

SEQ ID NO: 255 - DNA, 2740 bp, Tomato leaf curl New Delhi virus
accgaatggccgcgcaaatttttatgtgggaccccgaccaatgaaattcgacctacatgacttctttaatgcatggggtcctttaaatagacttgctcaccaagtttggatccacaaacatgtgggatccattgttgcacgaatttccagaaagcgttcatggtctaaggtgcatgctagctgtaaaatatctccaagagatagaaaagaactactccccagacacagtcggctacgatcttgtccgagatctcattcttgttctccgagcaaagaactatggcgaagcgaccagcagatatcatcatttcaacgcccgcatcgaaagtacgccgtcgtctcaacttcgacagcccctatggagctcgtgcagttgtccccattgcccgcgtcacaaaagcaaaggcctggacaaacaggccgatgaacagaaaacccagaatgtacagaatgtatagaagtcccgtcgtgccaaggggatgtgaaggcccttgcaaggtgcagtccttcgaatccaggcacgatgtctctcatattggcaaagtcatgtgcgttagtgatgttacccgaggaactggactcacacatcgcgtaggaaagcgattttgtgtgaaatctgtgtatgtgctggggaagatatggatggatgaaaacatcaagacgaaaaaccatactaacagtgttatgttctttttggtccgtgaccgtcgtcctacaggatccccccaagatttcggggaagtttttaacatgtttgacaatgaaccgagcacagcaacggtgaagaacatgcatcgtgatcgttatcaagtgttaaggaagtggcatgcgactgtgacgggaggaacatatgcatctagggagcaagcattagttaggaagtttgttagggttaataattatgtcgtttacaatcaacaagaggccggcaagtatgagaatcatactgaaaacgcattaatgttgtacatggcctgtactcacgcatcaaatcctgtatatgctactttgaaaatccggatctatttctatgattcggtcacaaattaataaatatcaagctttatatcataagacgtccatacatcaatcgtctgttccaatacattatccaatacatgataaactgctcttattacattatatattcctatgacacctaacatatccaggtacttaaggacctgggttttgaagactctcaagaaaatcccaatctgagggcgtaagcccgtccagatttggaaagttagaaaacacttgtgaagccccagggctttccgcaggttgtggttgaattgtatttgaatcttgattatgtcgtgctgtgttaggaagggcctgctgtcgtgtttcaaaattttgaaatacaggggatttcgaatttcccaggtatatacgccactctctgctcgatccgcagtgatgtattcccctgtgcgtgaatccgtgatcatggcagttgatcgatacgtaatacgaacaaccacacggaagatcaactcgcctcctgcgaatgctcttcttcttcttctgggggagcgatgttttcgcgaccggaatagagtggttcttcgagtgtgatgaagactgcattcttgagtgcccactgcttcagtgctgcattcttctcttcgtccagatattccttatagctgctgttcggacctttattgcacaggaagatagtgggaattccacctttaatcatgactggctttccgtacttcgtgttgctttgccagtcacgctgggcccccatgaattctttaaagtgctttagatagtggggatcaacgtcgtcgatgacgttgtaccaagcatcattgctgtacacctttgggctcagatctagatgtccacacaagtaattgtgtggtcctaagcaacgagcccacattgttttgcccgtcctactatccccctctatgactacacttattggtctaaaaggccgcgcagcggcacacacaacatttgacgtgacccaatcgacgagttctggcggaactctgtcgaaggaagaaattgaaaatggagagacataaacctcagaacgaggttgaaaaatgcgatctaaatttgtaattaaattgtgaaactgcagaacataatcctttggtgcaagttcttttaatactctcatcgcatcatctttatttcctgtattaatcgcttgagcatatgcatcgttcgctgtctgttgaccaccacgagcagatcgtccatcgatctggaaaacaccccattctagaacgtctccctctttgtcgatgtatgctttgacgtccgatgctgatttagctccctgaatgttcggatggaaatgtgctgaccgacttggggacaccaagtcgaagaatctgttatttttgcattggtattttccttcgaattggatgagaacatggatatgcggagtcccatcttcgtgaagctctcgacagatcttgatgaatttcttcgaagttggggtttctagggtttgtaattgggaaagtgcctcttcctttgtaagagagcacttaggatacgtgaggaaatagttttttgcatttattctaaaacgacttggcggaggcataaaacttgtcgtttcgatccggtgtctctcaactttctctatgtaattggtgtctggagtcccatatataggtaagacaccatatggcagaattgtaattttgaaaagaaaattactttaattcaaaatccctaaagcggccattcgtataatatt

SEQ ID NO: 256 - DNA, 2593 bp, Tomato severe leaf curl virus
accggatggccgcgattttttttggacctggcccactatcagaaattgcgttgggccttcctggataaagttaaccaatcagtactcgtttgggtagtctaattattactaacttggtcaccaagttgttttatggtctataaatttgtcgttatgtgtgtggtccaaccacgtaaatattgataatgcctaagcgtgatgccccatggcgcttaatggcgggtacccctaaggtgagtcggtcctccaaccagtctccccggactggtactgggcctaaatttgataaggcccatgcctgggttaacaggcccatgtataggaagcccaggatatatcgggcttggagaacgcccgacgttccaaggggctgtgaaggcccatgtaaggtccagtcctacgagcaacgacacgatatctcccacgtggggaaggtcatgtgcatatccgatgtcacacgtggtaatggtatcacccaccgtgttggtaagcggttttgtgttaagtctgtgtatatcctcggtaagatatggatggacgagaacatcaagctgaagaaccacacgaacagtgtcatgttctggttagtcagggaccgtagaccctatggtacgcctatggatttcggccaggtgttcaacatgtttgacaatgagcccagcactgccacggtcaagaccgatctacgcgatcgttaccaggtcatgcacaagttctatggcaaggtgacaggtggacagtatgccagcaacgagcaggctatagtcaagcgattctggagggtcaacaaccatgtggtctacaatcaccaagaggctggcaagtatgagaatcacacggagaacgccctgttattgtatatggcatgtactcatgcctctaaccctgtgtatgctactcttaagatccggatctatttttatgattcggtattgaattaataaaatttgaattttattgaatgattttccagtacatgagatacatacgacctgtttgtcgcgaatcgtacagctctgataacattgttaatgcaaataacacctaacctatctaaatacaataagactaaatatttaaatctacttaagtaagtcgtcccagaagcttgaactgatgtcgtccagatttggtagttgaggtaggctttgtgtagactcagcgccttcctgaggttgtggttgaaccgtatttggatgtggtatatcctggtgttgctgtaaattgggtcctctacattgattatcgtgaaataaaggggatttggtacctcccagataaaaacggaattctctgcctgatccgcagtgatgctctcccctgtgcgtgaatccatggttggcgcagtcgatgtgctggtagaacgagcagccacagtttaggtctattctctttcgacgaatcctggactttgcaattttgtgtttaggcttgatagagggtggagttgaggaagatgaattttgcattgtggagtgtccaatcttttagtgctttgttttcctctttttcgaggaaacttttatagctggccccctcaccaggattgcagagcacgattgacggtattccccctttaatttgaactggcttcccgtatttgcaatttgattgccagtccttttgggccccaatcagctctttccaatgcttcatctttaaatattgcggagtgatgtcatcaatgacgttgtattccgcttcatttgagtaaaccctagaattgaaatctaggtgtccactcaaataattgtgtgggcctaaggcacgcgcccacattgtctttcccgtcctcgattcaccctcgatgattatacttataggtctctccggccgcgcagcggcatccctaccaaaataatcatctgcccattcttgcatctcgtccggaacgttcgtgaacgacgagagtggaaacggaggaacccagggttccggagccttttgaaagagccgctcgatgttagctttgacgttatggtagcttacaatgaacgtctttgggtctccggcccttataatgtcgagagcctctccagcactagctgcattgacggcgttgtggtagacgtcgtctttgtttgattttgtacccccagacaccttgtattgtccggattcacaataatcaccttctttggtgatgtaattctggacggcgttggtgtctttggctgcctgtgcgtttggatgaaaattggcagaccttctggggtgagtgaggtcgaaaaatctagcatccttgatgttggacttcccggagagttggatgagacagtggaggtgcggaaatccatctgcgtgttcctctctggcgactcgtatgtacgttggtttgacgactgaccatggcagattttgaagcatttcaatagcttcatctttggggatatcacactgtggatatgttaagaaaatatttttggcagctagacgaaataaattagggttccgtggcatttttgtaaatatgagccaggacaccagggggagctctctctaaaactttattttgctggtgtcctggtgtcccatttatactaaaaccctcttggggacaccaagggcaaattcggccatccgcaataatatt

SEQ ID NO: 257 - DNA, 2593 bp, Tomato severe leaf curl virus
accggatggccgcgattttttttggacctggcccactaagggaaatagcgttgggccttcctggataaagttaaccaatcattgcacgcgtatgtagtctaattattaacaacttggcgaccaagttttttcatggtctataaatttgtcgttatgtgtgtggtccaaccacacaaatattgataatgcctaagcgtgatgccccatggcgcttaatgtcgggtacccctaaggtgagccgctcgtctaattatgttcctcctgatggattgggccgtaaatttgataagtcttctgcttgggccaacaggcccatgtacagaaagcccaggatatatcggaccgtaaggtctgccgatgttccaagaggctgtgaagggccatgcaagattcagtcgtttgagcagcgtcatgatatctctcatactgggaaggtgatgtgcatctccgatgttactcgtggtaatggtattacccatcgggttggtaaacgtttctgcgttaagtctgtgtacatattagggaagatctggatggacgataacatcaagttgaagaaccacactaacagcgttatgttttggctagttagggataggaggcctaatggaacggctatggattttggtcacctctttaacatgttcgacaatgagcctagtaccgccactgtgaagaacgatctccgagatcgtttccaagtgatgcacaggtttcatgcgaaggttacaggtggtcagtatgcaagcaatgagcagacgttggtgaagcgtttttggcgggtgaatcaacgtgtaacgtataataatcaagaggcggctcggtatgaaaaccatacggagaacgccttaatgttgtacatggcatgtactcatgcctctaaccctgtatatgctactcttaagatccggatctatttttatgattcggtgttaaattaataaattttgaattttattgaataattctcaagtacatgatttacatatgatttatctgttgcgaagcgaacagctctgattacattattaatgcaaataacacctaacctatctaaatacaataagactaaatatttaaatctacttaagtaattcgtcccagaagctcgaactgatgtcgtccagatttggtagttgaggtatgctttgtgtagactcaactccttcctgaggttgtggttgaaccgtatttggatgtggtatatcctggtgttggtgtaagttgggtcttctacactgattatcgtgaaataaaggggatttggtacctcccagataaaaacggaattctctgcctgagccgcagtgatgctctcccctgtgcgtgaatccatggttggcgcagtcgatgtgctggtagaaggagcagccacagtttaggtctatcctcttgcgacgaatcctggactttgcaattttgtgcttaggcttgatagagggtggagttgaggaagatgaattttgcattgtggagtgtccaatcttttagtgctttgttttcctctttttcgaggaaagctttatagctggccccttctcctggattgcaaagcacgattgacggtattccccctttaatttgaactggcttcccgtatttgcaatttgattgccagtccttttgggccccaattagctctttccaatgcttcatctttaaatattgcggagtgacatcatcaatgacgttatactccgcttcatttgagtaaaccctagaattgaaatctaggtgtccactcaaatagttatgtgggcctaaggcacgcgcccacattgtcttccctgtcctcgaatcaccctcgatgattatacttataggtctctccggccgcgcagcgacatccctaccaaaataatcatctgcccattcttgcatctcgtccggaaagtgcgtgaacgacgagagtggaaacggaggaacccatgggtccggagccttctgaaagagtcgctcgatgttagccttcacattatggtagcttacaatgaacgtcttggggtctccggcccttataatgttgatagcctctccagcactagctgcattgacggcgttgtggtagacgtcgtctttgtttgactttgtacccccagataccttgtattgtccggattcacaataatcaccttctttggtgatgtaattctggacggcgttggtgtctttggctgcctgtgcgtttggatgaaaattggcagtccttctggggtgagtaaggtcgaaaaatctagcatccttgatgttggactttccggagagttgaataagacagtggaggtgcggaaatccatctgcgtgttcctctctggcgactcgtatgtacgttggtttgacgactgaccatggcagattttgaagcatttcaatagcttcatctttggggatatcacactgtggatatgttaagaaaatatttttggcagctagacgaaataaattagggttccgtggcatttttgtaaatatgagccaggacaccagggggagctctctctaaaactttattttgctggtgtcctggtgtcccatttatactaaaaccctcttggggacaccaagggcaatatcggccatccgcaataatatt

SEQ ID NO: 258 - DNA, 2593 bp, Tomato severe leaf curl virus
accggatggccgcgattttttttggacctggcccactaagggaaatagcgttgggccttcctggataaagttaaccaatcattgcacgcgtatgtagtctaattattaacaacttggcgaccaagttttttcatggtctataaatttgtcgttatgtgtgtggtccaaccacacaaatattgataatgcctaagcgtgatgccccatggcgcttaatgtcgggtacccctaaggtgagccgctcgtctaattatgttcctcctgatggattgggccgtaaatttgataagtcttctgcttgggccaacaggcccatgtacagaaagcccaggatatatcggaccgtaaggtctgccgatgttccaagaggctgtgaagggccatgcaagattcagtcgtttgaacagcgtcatgatatctctcatactgggaaggtgatgtgcatctccgatgttactcgtggtaatggtattacccatcgggttggtaaacgtttctgcgttaagtctgtgtacatattagggaagatctggatggacgataacatcaagttgaagaaccacactaacagcgttatgttttggctagttagggataggaggcctaatggaacggctatggattttggtcacctctttaacatgttcgacaatgagcctagtaccgccactgtgaagaacgatctccgagatcgtttccaagtgatgcacaggtttcatgcgaaggttacaggtggtcagtatgcaagcaatgagcagacgttggtgaagcgtttttggcgggtgaatcaacgtgtaacgtataataatcaagaggcggctcggtatgaaaaccatacggagaacgccttaatgttgtacatggcatgtactcatgcctctaaccctgtatatgctactcttaagatccggatctatttttatgattcggtgttaaattaataaattttgaattttattgaataattctcaagtacatgatttacatatgatttatctgttgcgaagcgaacagctctgattacattattaatgcaaataacacctaacctatctaaatacaataagactaaatatttaaatctacttaagtaattcgtcccagaagctcgaactgatgtcgtccagatttggtagttgaggtatgctttgtgtagactcaactccttcctgaggttgtggttgaaccgtatttggatgtggtatatcctggtgttggtgtaagttgggtcttctacactgattatcgtgaaataaaggggatttggtacctcccagataaaaacggaattctctgcctgagccgcagtgatgctctcccctgtgcgtgaatccatggttggcgcagtcgatgtgctggtagaaggagcagccacagtttaggtctatcctcttgcgacgaatcctggactttgcaattttgtgcttaggcttgatagagggtggagttgaggaagatgaattttgcattgtggagtgtccaatcttttagtgctttgttttcctctttttcgaggaaagctttatagctggccccttctcctggattgcaaagcacgattgacggtattccccctttaatttgaactggcttcccgtatttgcaatttgattgccagtccttttgggccccaattagctctttccaatgcttcatctttaaatattgcggagtgacatcatcaatgacgttatactccgcttcatttgagtaaaccctagaattgaaatctaggtgtccactcaaatagttatgtgggcctaaggcacgcgcccacattgtcttccctgtcctcgaatcaccctcgatgattatacttataggtctctccggccgcgcagcgacatccctaccaaaataatcatctgcccattcttgcatctcgtccggaacgtgcgtgaacgacgagagtggaaacggaggaacccatgggtccggagccttctgaaagagtcgctcgatgttagccttcacattatggtagcttacaatgaacgtcttggggtctccggcccttataatgttgagagcctctccagcactagctgcattgacggcgttgtggtagacgtcgtctttgtttgattttgtacccccagataccttgtattgtccggattcacaataatcaccttctttggtgatgtaattctggacggcgttggtgtctttggctgcctgtgcgtttggatgaaaattggcagtccttctggggtgagtaaggtcgaaaaatctagcatccttgatgttggactttccggagagttgaataagacagtggaggtgcggaaatccatctgcgtgttcctctctggcgactcgtatgtacgttggtttgacgactgaccatggcagattttgaagcatttcaatagcttcatctttggggatatcacactgtggatatgttaagaaaatatttttggcagctagacgaaataaattagggttccgtggcatttttgtaaatatgagccaggacaccagggggagctctctctaaaactttattttgctggtgtcctggtgtcccatttatactaaaaccctcttggggacaccaagggcaatttcggccatccgcaataatatt

SEQ ID NO: 259 - DNA, 2588 bp, Tomato severe leaf curl virus
accggatggccgcgttttttttggacctggcccactatcagaaattgcgttgggccttcctggataaagttaaccaatcagtacacgtttgggtagtctaattattactaacttggtcaccaagttgttttatggtctataaatttgtcgttatgtgtgtggtccaaccacgcaaatattgataatgcctaagcgtgatgccccatggcgcttaatggcgggtacccctaaggtgagtcggtcctctaaccagtctccgcggactggtactgggcctaaatttgataaggcccatgcctgggtaaacaggcccatgtataggaagcccaggatatatcgggcttggagaacgcccgatgttccaagaggctgtgaaggcccatgtaaggtccagtcctacgagcaacgacacgatatctcccatgtggggaaagtcatgtgcatatccgatgtcacacgtggtaatggtattacccaccgtgttggtaagcggttctgtgttaagtctgtgtatatcctcggtaagatatggatggacgagaacatcaagctgaagaaccacacgaacagtgtcatgttctggttagtcagggaccgtagaccctatggtacgcctatggatttcggccaggtgttcaacatgtttgacaatgagcccagcactgccacggtcaagaacgatctacgcgatcgttaccaggtcatgcacaagttctatggcaaggtgacaggtggacagtatgccagcaacgagcaggctatagtcaagcgattctggagggtcaacaaccatgtggtctacaatcaccaagaggctggcaagtatgagaatcacacggagaacgcgttgttattgtatatggcgtgtactcatgcctctaaccctgtatatgctactcttaagatccggatctatttttatgattcggtattgaattaataaaatttgaattttattgaatgattttctaatacatgatttacatatgatctgtccgttgcgaagcgaacagctctgataacattattaatgcaaataacacctaacctatttaaatataataagactaaatatttaaatctacttaagtaattcgtcccagaaacttgaactgatgtcgtccagatttggtagttgaggtacgctttgtgtagactcagcgccttcctgaggttgtggttgaaccgtatttggatgtggtatatcctggtgttggtgtaaattgggtcttctacactgattatcgtgaaataaaggggatttggtacctcccagataaaaacggaattctctgcctgatccacagtgatgctctcccctgtgcgtgaatccatggctggcgcagttgatgtgctggtagaacgagcagccacagtttaggtctatcctcttacgacgaatcctggattttgcaattttgtgtttaggcttgatagagggtggagttgaggaagatgaattttgcattgtgtagtgtccaatcttttaatgctttgttttcctctttttcgaggaaacctttatagctggcctctcctggattgcagagcacgattgacggtattccccctttaatttgaactggcttcccgtatttgcaatttgattgccaatccttttgggccccaatcagctctttccaatgcttcatctttaaatactgcggagtgatgtcatcaatgacgttgtactccgcttcatttgagtaaaccctagaattgaaatctaggtgtccactcaaataattgtgtgggcctaaggcacgtgcccacattgtctttcccgtcctcgattcaccctcgatgattatacttataggtctctccggccgcgcagcggcatccctaccaaaataatcatctgcccattcctgcatctcgtccggaacgttcgtgaacgacgagagtggaaacggaggaacccagggttccggagccttctgaaagagccgctcgatgttagctttgacgttatggtagcttacaatgaacgtcttggggtctccggcccttataatgttgagagcctctccagcactagctgcattgacggcgttgtggtagacgtcgtctttgtttgattttgtacccccagacactttgtattgtccggattcacaataatcaccttctttggtgatgtaattctggacggcgttggtgtctttggctgcctgtgcgtttggatgaaaattggcagaccttctggggtgagtgaggtcgaaaaatctagcatccttgatgttggacttcccggagagttggatgagacagtggaggtgcggaaatccatctgcgtgttcctctctggcgactcgtatgtacgttggtttgacgactgaccatggcagattttgaagcatttcaatagcttcatctttggggatatcacactgtggatatgttaagaaaatatttttggcagctaggcgaaataaattagggttccgtggcatttttgcaaatatgagccaggacaccagggggagctctctctaaaactttattttgctggtgtcctggtgtcccatttatactaaaaccctctggggacaccaagggcaaattcggccatccgcaataatatt

SEQ ID NO: 260 - DNA, 2594 bp, Tomato severe leaf curl virus
accggatggccgcgattttttttggacctggcccactatcagaaattgcgttgggccttcctggataaagttaaccaatcagtacacgtttgggtagtctaattattactaacttggtcaccaagttgttttatggtctataaatttgtcgttatgtgtgtggtccaaccatgcaaatagtgataatgcctaagcgtgatgccccatggcgcttaatggcgggtacccctaaggtgagtcggtcctctaaccagtctccccggactggtactgggcctaaatttgataaggcccatgcctgggtaaacaggcccatgtataggaagcccaggatatatcgggcttggagaacgcccgatgttccaagaggctgtgaaggtccatgtaaggtccagtcctacgagcaacgacacgatatctcccacgtggggaaagtcatgtgcatatccgatgtcacacgtggtaatggtatcacccaccgtgttggtaagcggttctgtgttaagtctgtgtatatcctcggtaagatatggatggacgagaacatcaagctgaagaaccacacgaacagtgtcatgttctggttagtgagggaccgtagaccctatggtacgcctatggatttcggccaggtgttcaacatgtttgacaatgagcccagcactgccacggtcaagaacgatctacgcgatcgttatcaggtcatgcacaagttctatggcaaggtgacaggtggacagtatgccagcaacgagcaggctatagtcaagcggttctggagggtcaacaaccatgtggtctacaatcaccaagaggctggcaagtatgagaatcacacggagaacgcgttgttattgtatatggcgtgtactcatgcctctaaccctgtgtatgctacccttaagatccggatctatttttatgattcggtattaaattaataaaatttgaattttattgaatgattttctaatacatgatttacatacgatctgtctgttgcgaagcgaacagctctgataacattattaatgcaaacaacacctaacctatctaaatacaataagactaaatatttaaatctacttaagtaattcgtcccagaaacttgaactgatgtcgtccagatttggtagttgaggtacgctttgtgtagactcagcgccttcctgaggttgtggttgaaccgtatttggatgtggtatatcctggtgttggtgtaaattgggtcctctacactgattatcgtgaaataaaggggatttggtacctcccagataaaaacggaattctctgcctgatccacagtgatgctctcccctgtgcgtgaatccatggttggcgcaatcgatgtgcaggtagaacgagcagccacagtttaggtctatcctctttcgacgaatcctggactttgcaattttgtgcttaggcttgatagagggtggagttgagggagatgaattttgcattgtggagtgtccaatcttttagtgctttgttttcctctttttcgaggaaagttatacagctggacccttctcctggattgcagagcacgattgtcggaactccccctttaatttgaactggcttcccgtatttgcaatttgattgccagtccttttgggccccaatcagctctttccaatgcttcatctttaaatattgcggagtgatgtcatcaatgacgttatattccgcttcatttgagtaaaccctagaattgaaatctaggtgtccactcaaataattgtgtgggcctaaggcacgcgcccacattgtctttcccgtcctcgattcaccctcgatgattatacttataggtctctccggccgcgcagcggcatccctaccaaaataatcatctgcccattcttgcatctcgtccggaacgttcgtgaacgacgagagtggaaacggaggaacccatggttccggagccttctgaaagagccgctcgatgttagctttgacgttatggtagcttacaatgaacgtcttgggatctccggcccttataacgtcgagagcctctccagcactagctgcattgacggcgttgtggtaaacgtcgtctttgtttgattttgtacccccagacaccttgtattgtccggattcacaataatcaccttctttggtgatgtaattctggacggcgttggtgtctttggctgcctgtgcgtttggatgaaaattggcagaccttctggggtgagtgaggtcgaaaaatctagcatccttgatgttggacttcccggagagttggatgagacagtggaggtgcggaaatccatctgcgtgttcctctctggcgactcgtatgtacgttggtttgacgactgaccatggcagattttgaagcatttcaatagcttcatctttggggatatcacaatgtggatatgttaagaaaatatttttggcagctagacgaaataaattagggttccgtggcatttttgtaaatatgagccaggacaccagggggagctctctctaaaactctatgttgctggtgtcctggtgtcccatttatactaaaaccctctggggggacaccaagggcaaattcggccatccgcaataatatt

SEQ ID NO: 261 - DNA, 2631 bp, Pepper Huasteco yellow vein virus
ggccatccgttataatattaccggatggccgaccgcttaccttatctatccgtactgctttatttgaattaaagatgttacttttatgctatccaatgaagcgtagcgtctgggaagcttagttatcagttccagacgtggggaccaagtagtgtatgaccactttattgactgtcagctttataaattgaaattaaaacataagtggtccatgtacctttaattcaaaatgcctaagcgtgatgctccttggcgattaacggcggggaccgccaagattagccgaactggcaataattcacgggctcttatcatgggcccgagtactagcagggcctcagcttgggttaatcgcccaatgtacaggaagccccggatttatcgtatgtacagaactccggatgtgccgaaaggttgtgaaggtccctgtaaggttcaatcgtttgaacaacgacatgacgtctctcatgttggtaaggttatttgtatatccgacgtaactcgtggtaatggtattacccatcgtgttggcaaacgattctgcgttaagtctgtctatattctgggcaaaatctggatggatgaaaatattaagttgaagaaccataccaacagtgtcatgttttggttggttagggataggagaccctacggtacgcctatggattttggccaagtctttaacatgtatgacaacgagcccagtaccgctactgtgaagaacgatcttcgggatcgttatcaagttatgcatagattctatgctaaggtcactggtgggcaatatgcaagcaacgagcaagccttggttaggcgtttctggaaggtgaacaaccatgttgtgtataaccatcaagaagctgggaaatatgagaaccacacggagaatgcgctgttattgtatatggcatgtactcatgcatctaatcccgtgtatgcaacactcaaaattcgggtctatttttatgactcgataatgaattaataaagtttgtatattatttcatgattctcaagtacagcattgacataacgtttgtctgtagcaaacgaaacagccctaattacattgttaactgaaataagacctaagttatctagataaaacatgacaagcaatttaaatctatttaagtaaatctgcccagaaatcgtcgtcaacgtcgtccagacttggaagttgaagtaggctttgtggagacccaacgctgtcctcatgttgtggtttgctctgacttgaatgtgaaatacccggctgcgtgtgtacattggcgtctccactagccgtattttgaaatataggggatttcgaagctcccagataaaaacgccattcgctgcttgagctgcagtgatgggtaccccggtgcgtaaatccattgttaacacagttaatatgtatataaattgaacagccgcaagcgagatcaatccttctacgtcgtatctgtctctttgcaaatctatggcgaagtttgacttccggtggtgaagatagcttcttcgatggtgacgtagatggcgtttttttggacccagtcattgaggctcctatttttctcttcgctgaggtagtctttataggaagactgggggcccggattgcaaagaaagatagtgggtatcccacctttaatttgaattggtttgccgtatttgcagtttgattgccaatcccgttgggcccccataaactctttaaagtgcttaacataatgcggagggatgtcatcaatgacgttataccatgcattattggagtagatttttgggctgagatccatatgaccacatatgtaattgtgtgggccgagacttcgggcccataatgttttgcctgtccgtgaaggaccctcgaccactaatgacaatggtctcattggccgcgcagcggcatcacatacattatcagacacccattgtgtcattattgcaggcacattattaaaggacgcctgttgaaatggaggaacccacggttccgggggagtttggaatatccgattagcgtttgacacaatgttatgaaattggaggaagaaatgctgaggttgttcttcctttatgatctgcagagcttcttctgcagatgctgaatttaacgccttagcatatgtgtcattagcagactgctgtcctcctctagcagatctgccgtctatttggaattctccccattctacggtatcgccgtctttgtcgatgtacgtcttgacgtcggagcttgatttagctccctgaatgttcggatggaaatgtgctgatctggtagaggatacgaggtcaaagaatcggttgttcgtgcattggtattttccttcgaactgaataagcacgtgcagatgaggttgcccatcttcatgagattctttgcaaattttgatgtacttcttgtttaccggcgtcgagaggttttgtagttgagcgagacgctcttctttggaaatggaacattgtggataggtgaggaaataattcttggcatttaaacgaaatcgtttaggtaatggcatatttgtaataagagaggtgtacaccgattggagctctttaacctgggcttattgtatcggtgtattggtagccaatatatagtatatgggagttatctaggatcttcgtacacgtgag

SEQ ID NO: 262 - DNA, 2631 bp, Pepper Huasteco yellow vein virus; identical to SEQ ID NO: 261

SEQ ID NO: 263 - DNA, 2630 bp, Pepper Huasteco yellow vein virus
ggccatccgttataatattaccggatggccgaccgcttaccttatctatccgtactgctttattttgaattaaagatgttacttttatgctatccaatgagcgtgcgtctgggaagcttagttaaccgttccagacgtggggaccaagtagtgtatgaccactttattgactgtcagctttataaattcaaattaacacataagtggtccatatacctttaattcaaaatgcctaagcgtgatgctccttggcgattaacggcggggaccgccaagattagccgaactggcaataattcacgggctcttatcatgggcccgagtactagcagggcctcagcttgggttaatcgcccaatgtacaggaagccccgcatttatcgtatgtacagaacgccggatgttccgaaaggttgtgaaggtccctgtaaggttcaatcgtttgaacaacgtcatgacgtgtctcatgttggcaaggttatttgtatatccgacgtcactcgtggtaatggtattacccatcgtgttggcaaacgattctgcgttaagtctgtctatattctgggcaaaatctggatggatgaaaatattaagttgaagaaccataccaacagtgtcatgttttggttggttagggataggagaccctacggtacgcctatggattttggccaagtctttaacatgtatgacaacgagcccagtaccgctactgtgaagaacgatcttcgggatcgttatcaagttatgcatagattctatgctaaggtcactggtgggcaatatgccagcaacgagcaagccttggttaggcgtttctggaaggtgaacaaccatgttgtgtataaccatcaagaagctgggaaatatgagaaccacacggagaatgcgctgttattgtatatggcatgtactcatgcatctaatcccgtgtatgcaacactcaaaattcgggtctatttttatgactcgataatgaattaataaagtttgtatattatttcatgattttcaagtacagcattgacataacgtttgtctgtagcaaacgaaacagctctaattacattgttaactgaaataacacctaagttatctagataaaacatgacaagcaatttaaatctatttaagtaaatctgcccagaaatcgtcgtcaacgtcgtccagacttggaagttgaagtaggctttgtggagacccagcgctctccgcatgttgtggtttgctctgacctgaatgtgaaacaccctgctgtttgtgtacattggcgtctccacatgcattattctgaaatataggggatttggaagctcccatataaaaacgccattcgttgcttgagctgcagtgatgggttcccctgtgcgtaaatccatagttactgcaattaatatttatgtatatagaacagccgcaagcgagatcaacacgtctacgtcgtatctgtcgctttgcaaatctatggcgaagcttcacttccggtggtgaagatagcttcttcgatggtgacgtagatggcgtttttttggacccagtcattgaggctcctatttttctcttcgctgaggtactctttataggaagactgggggcccggattgcaaagaaagatagtgggtatcccacctttaatttgaattggtttgccgtatttgcagtttgattgccaatcccgttgggcccccataaactctttaaagtgcttaacataatgcggagggatgtcatcaatgacgttataccatgcattattggagtagatttttgggctgagatccatatgaccacatatgtaattgtgtgggccgagacttcgggcccataatgttttgcctgtccgtgaaggaccctcgaccactaatgacaatggtctcagtggccgcgcagcggcatcacatacattatcagacacccattgtgtcattattgcaggcacattattaaaggacgcttgttgaaatggaggaacccacggttccgggggagtttggaatatccgattagcgtttgacacaatgttatgaaattggaggaagaaatgctggggttgttcttcctttatgatctgcagagcttcttctgcagatgctgaatttaacgccttagcatatgtgtcattagcagactgctgtcctcctctagcagatctgccgtctatttggaattctccccattctacggtatcgccgtctttgtcgatgtacgtcttgacgtcggagctagatttagctccctgaatgttcggatggaaatgtgctgatctggttgaggatacgaggtcaaagaatctgttgttcgtgcattggtattttccttcgaactgaataagcacgtgcagatgaggttgcccatcttcatgagattctttgcaaattttgatgtacttcttgtttaccggcgtcgagaggttttgtagttgagcgagagcctcttctttggaaatggaacattggggataggtgaggaaataattcttggcatttaaacgaaatcgtttaggtaatggcatatttgtaataagagaggtgtacaccgattggagctctttaacctgggcttattgtatcggtgtattggtagccaatatatagtatatgggagttatctaggatcttcgtacacgtgga

SEQ ID NO: 264 - DNA, 2613 bp, Pepper golden mosaic virus
accggatggccgcgattttttggagtctttaggggaccactcacaatagagggctgagattaaatagacagagtgaggggaccaccaattatttgattttgactgaccaatcacatcccgcctgtcaagtctagatatttgtgccttggtgaccaaggtgtgggcctataaatgcacgtgcatctgcatttatcgctttaattcaaaatggttaagcgggatgccccatggcgtttaatggcggggacctctaaggtttccggctctgcgaattattcacgtggcacgggtatggggcctaaattcgataaggccgctgcttgggttaacaggcccatgtacaggaagcccagtatatatcgtacgtatagaagcccagatgtgcctagassatgtgaagggccatgtaaggtccagtccttcgagcagcggcatgatatctcgcatgttggcaaggtcatgtgcatttctgacgtgacacgtggtaatggtattacccatcgtgtaggcaagcgtttctgcgtcaagtctgcatacgttctgggtaagatatggatggacgagaatatcaagctcaagaaccacaccaacagcgtcatgttctggctcgtgagagataggagaccatatggtacccctatggactttggtcaggtgttcaacatgtatgacaacgagcccagtacagctactgtgaagaacgatttgcgtgatcgtttccaagtcatgcacaggttctcggctaaggtcacaggtggacagtatgccagcaacgagcaggcattggttaggcgtttctggaaggtgaacaactacgtcgtgtacaaccatcaggaagctggcaaatacgagaatcatactgagaacgccctgctattgtatatggcatgtacacatgcctctaaccctgtgtacgcgacattgaaaattcgaatctatttttatgattcgataacaaattaataaagtttgcattttatttcatgattctcaagtacataatttacataggatttgtccgtcgcaaaacgaacagctctgattacattgtttatgcctatggcccctagcgtatgtaaatacaacatgacgcgaaatttgaatctacttaaatatgtcgtcccagaagctgtcatcgaagtcgtccagacttggaaatggaggaatgccttgtggagagctaatgctcgacgtaggttgtggttgaaccggactacgatgtggtatatcctggttctggtgaacaacgggtcctccacgtgctgtatcctgaaaaataggggatttggaacctcccaaataaaaacggaattctctgcctgatgcacagtgatgctctcccctgtgcgtgaatccattattagcgcagttgatgtggagaaagatagagcagccgcagtttaggtctatgcgtcgtctgcgaataggtcgcttcttagctatcctgtgctgtgcttttatagaggggagcgtggaggatgacgaattgagcattttttaatgtccacgctcttaattctgcattttcctctttgttgaggaaagctatatagctgctaccttcccctggattgcacagcacgattgatggtatcccgcctttaatttgaactggctttccgtatttacagttggactgccagtctttttgggccccaataagctctttccagtgtttcatctttagatattggggcgtgatatcatcaatgacgttatactccacatagtttgaatagacctttgcattgaaatcaagatgaccgctcaaataattatgtgggcctagtgcacgtgcccacattgtcttgccgcatcgcgaatcaccctcaatgacaatactaatcggtctatctggccgcgcacaactccgaccaaaatattcagcaacccaatgttgcatatcctcaggaacgttgttaaacgaggataatggataaggaggagtccatggcataggaggagttgtaaataggcgctcgatgttagcctttatgttatgataactaacaatgaacgttttcggatcaccagctttgattatgtcgagcgcctcccccgcacttgcagcatttacagcgttatggtagacgtcgtctttatttgcttttgaccccccggaaactttgtactgcccagattcacaataatcaccatcttttgttatgtaatttttaacggcatttgcgtccttggatgcctgaacgtttggatgaaactgggcagatctccgggggtgagtaatgtcgaagaaccgggcatctttgatgttgcattttccagtcaactggattagacagtgcaagtgcgggaacccatcggaatgctcctctcgtgatacccggagatagatgggttttaccactgcccattttaaattacggagcatttcgagagcttcatcctttgggatatcgcattgtggatatgttaagaaaatgtttttacattgtaaacgaaaggattttggtggtagtggcatttttgcaaatatggtgtaggactccagcagagtccctcaacttctgtcatatgttgtggagtcctggagtcccttatatacataaagcctcttggggactccaagggcaaaagcggccatcctataatatt

SEQ ID NO: 265 - DNA, 2613 bp, Pepper golden mosaic virus; identical to SEQ ID NO: 264

SEQ ID NO: 266 - DNA, 2619 bp, Pepper golden mosaic virus
accggatggccgcgatttctcggagtcattgggggaccactcagaatagagggctgagatttaatagataaagagaggggaccaccaattatttgattttgactgcccaatcacatcccgcctgtcaagtctagatatttgttccttggtgaccaaggtgtggtcctataaatgcacgtgcatgtgcatttagacccttaattcaaaatggttaagcgggatgccccatggcgtttaatggcggggacctccaaggtttcccgctctgctaattattcacgtggcacgggtatgggccctaaattcgataaggccgctgcgtgggttaacaggcccatgtacaggaagcccaggatatatcggacctttagaagctctgatgttcctagaggctgtgaaggaccgtgtaaggtccagtcatttgagcagcggcatgatatctctcatgttggcaaggtcatgtgcatttcggacgtgacacgtggtaatggtattactcatcgtgtaggcaagcgtttctgtgtcaagtctgcatatgttttgggtaagatatggatggatgagaatatcaagctgaagaaccacaccaacagcgtaatgttctggttggtccgagataggagaccatatggtacccctatggatttcgggcaggtgttcaacatgtatgacaacgagcccagtacagccactgtaaagaacgatctgcgtgatcgttaccaagttatgtacaggttctcggctaaggtgacaggtggacagtatgccagcaacgagcaggcgttggttaggcgattttggaaggtgaacaactacgttgtctacaaccatcaagaagctggcaaatacgagaatcatactgagaacgccctcttattgtatatggcatgtacgcatgcatctaaccctgtgtacgcgacattgaaaattcgaatctatttctatgattcgataacaaattaataaagtttgtattttatttcatgatgctcaagtacataatttacataggatttgtccgtcgcaaagcgaacagctcgaattacattgtttatgcctatggcccctagtctatgtaaatacaacatgatgcgaaatttgaatctatttaaatatgtcgtcccagaagctgtcatcgaagtcgtccagacttggaaatgaaggaatgacttgtggagagccaaggctcggcgtaggttgtggttgaaccggacttcgatgtagtatatcctggttctggtgtccaacggggcctcgactcgttgtatcttgaaaaataggggatttggaaccttccaaataaaaacggaattctctgcctgacgcacagtgatgctctccccggtgcgtgaatccattatttgcgcagttgatgtggaagaagatagagcagccgcagtttaggtctattcgtcgtctgcgaacaggtctctttttagctatcctgtgctgtgcttttatagaggggagcgtggaggatgacgaattgagcatttttttgtgtccacgctctcaaaggtgcattttcctctttgttgaggaaagctatatagctgctaccttcccctggattgcacagcacaattgatggtatcccgcctttaatttgaactggctttccgtatttacagttggactgccagtccctttgggccccaataagctctttccagtgtttcaactttagataatggggcgtgatatcatcaatgacgttatactccacatcgtttgaatagacctttgaattgaaatcaaggtgaccgctcaaataattatgtgggcctaatgcacgtgcccacattgtcttgccgcttcgcgaatcgccctcaatgataatactaatcggtctatctggccgcgcagcggaactccgaccaaaatattcagcaacacaacgttgcatatcctcaggaacgttattaaacgacgaaagtggatacggaggagtccattgtttaggaggaggtttaaacagtcgctcgatgttagacttaacgttatgatagctgacaatgaacgttcttggatctccagcttttataatgtcgagcgcctctcccgcacttgctgcatttacagcgttatggtagacgtcgtctttatttgctttggaacctccggaaactttgtactgtccagtttcacaataatcaccatctttagtgatgtaattctttacggcatttgtgtctttagccgcctgaacgtttggatgaaactgggcagatctccgagggtgagtaatgtcgaagaaccgagcatctttgatgttgcacttacctgttaactggatgagacagtgcaagtgcggaaacccatcggaatgctcctcccgcgatacccgtatgtatatgggttttacaactgaccattttaacgactggagcatttcgagagcttcatcctttgggatatcgcattgtggatatgttaaaaaaatgtttttacattgtaaatgaaatgattttggtggtagtggcatttttgcaaatatgttgtaggactccaggagagtccctcataaaaccgtactatgtttgtggagtcctggagtcccttaaatactagaactctctgggggaactccaggggcaaaagcggccatcctataatatt

SEQ ID NO: 267 - DNA, 2615 bp, Pepper golden mosaic virus
actggatggccgcgattttttggagtctatcagggaccactcacaatagagggctgagattaaatagataaagagatgggaccaccaattatatgattttgactgaccaatcacatcccgcctgtcaagtctagatatttgtgccttggtgaccaaggtgtggtcctataaatgcacgtgcatgtgcatttaacctttaattcaaaatggttaagcgggatgccccatggcgtttaatggcggggacctccaaggtttcccgctcagccaattattcacgtggcacgggtatgggccctaaatttgataaggccgctgcttgggttaacaggcccatgtacaggaagcccaggatatatcggacttttagaagcccagatgttcctagaggttgtgaagggccttgtaaggtccagtcattcgagcagcggcatgatatctcgcatgttggcaaggtcatgtgcatttcggacgtgacacgtggtaatggtattactcaccgtgtaggcaagcgtttctgcgtgaagtctgcatacgttctgggtaagatatggatggacgagaatatcaagctcaagaaccacaccaacagcgtcatgttctggctcgtgagagataggagaccatatggtacccccatggattttggtcaggtgttcaacatgtatgacaacgagcctagcacagccaccgtgaagaacgatctgcgtgatcgtttccaagttatgcacaggttctctgctaaggtcactggtggacagtatgccagcaacgagcaggcgttggttaggcgcttctggaaggtgaacaactatgtcgtctacaaccaccaggaagctggcaaatacgagaatcatactgagaacgccctgttattgtatatggcatgtactcatgcctctaaccctgtgtacgcgacattgaaaattcgaatctatttttatgattcgataacaaattaataaagtttgaattttatttcatgattctcaagtacataatttacataggatttgtccgtcgcaaaacgaacagctgtgattacattgtttatgcctatggcccctagcctatgtaaatataacatgacgcgaaatttgaatctacttaaatatgtcgtcccagaagctgtcatcgaagtcgtccagatttggaaacggaggtatgccttgtggagagccaatgctcgacgtaggttgtggttgaaccggacttcgatgtggtatatcctggttctggtgaataacgggtcctccacgtgatgtatcctgaaaaataggggatttggaacctcccaaataaaaacggaattctctgcctgatgcgcagtgatgctctccccggtgcgtgaatccattattagcgcagttgatgtggagaaagatagagcagccgcagtttaggtctatgcgtcgtctgcgaataggtcgcttcttagctatcctgtgctgtgcctttatagaggggagcgtggaggatgacgaattgagcattttttaaggtccacgctcttaatgatgcattttcctctttgttaaggaaagctatatagctgctaccttcccctggattgcacagcacaattgatggtatcccgcctttaatttgaactggctttccgtatttacagttggactgccagtctttttgggacccaataagctctttccagtgtttcaactttagatattggggcgtgatatcatcaatgacgttatactccacatcgtttgaatagacctttgcattgaaatcaagatgaccgctcaaataattatgtgggcctagtgcacgtgcccacattgtcttgccgcttcgcgaatcaccctcaatgacaatactaatcggtctatctggccgcgcagcggaactccgaccaaaatattcagcaacccaatgttgcatatcatcagggacgttgttaaacgaggataatggataaggaggagtccatggcataggaggagttgtaaataggcgctcgatgttagcctttatgttatgataactaacaatgaacgtttttggatcaccagctttgattatgtcgagcgcctccactgcacttgctgcatttaccgcgttatagtagacgtcgtctttatttgcctttgtcaccccggaaactttgtagtgcccagtttcacaataatcaccttcttttgtgatgtaattcttcactgcatttgcatctttggctgcctgaacatttggatgaaactgggcagatctccgggggtgagtaatgtcaaagaaacgtgcatctttgatgttgcactttccagttagttggattagacagtgcaagtgcggaaacccatcggaatgctcctctcgtgatacccgaatgtagctgggttttactactgaccattttaatgaacggagcatttcgagagcttcatctttcgggatatcgcattgtggatatgttaagaaaatgtttttacattgtaaacgaaatgattttggaggtagtggcatttttgcaaatatggggtaggactccaggagagtccctcaacttctgtcatatattgtggagtcctggagtcccttatatacataaagcctcttgtggcctccaagggcaaaagcggccatcctataatatt

SEQ ID NO: 268 - DNA, 2618 bp, Pepper golden mosaic virus
actggatggccgcgatttttttggagtctttgggggaccactcagaatagagggctgagattaaatagataaagagatgggaccaccaattataggatatttgaccgaccaatcacatcccgcctgtcaagtctagatatttgtgccttggggaccaaggtgtggtcctataaatgcacgtgcatgtgcattaacctctttaattcaaaatggttaagcgggatgccccatggcgtttaatggcggggacctccaaggtttcccgctcagctaattattcacgtggcacgggtatgggccctaaattcgataaggccgctgcttgggttaacaggcccatgtacaggaagcccaggatatatcggacgtttagaagcccagatgttcctagaggttgtgaagggccctgtaaagtccagtcattcgagcagcggcatgatatctcccatgttgggaaggtcatgtgcatttcggacgtgacacgtggtaacggtatcactcatcgtgtaggcaagcgtttctgcgtcaagtctgcatacgttctgggtaagatatggatggacgagaatatcaagctcaagaaccataccaacagcgtcatgttctggctcgtgagagataggagaccatattgtacccctatggatttcggtcaggtgttcaacatgtatgacaacgagcccagtactgccactgtgaagaacgatcttcgtgatcgtttccaagtcatgcacaggttctcggctaaggtcacaggtggacagtatgccagcaacgagcaggcgttggttaggcgcttctggaaggtgaacaactacgttgtctacaaccaccaggaagctggcaaatacgagaatcatactgagaacgccctgttattgtatatggcatgtactcatgcatctaaccccgtgtacgcgacattgaaaattcgaatctatttttacgattcgataacaaattaataaagtttgaattttatttcatgattctcaagtacagcatttacataggatttgtccgtcgcaaaacgaacagctctaattacattgtttatgcctatggcccctagcctatgtaaatataacatgacgcgaaatttgaatctacttaaatatgtcgtcccagaagctgtcatcgaagtcgtccagatttggaaatgaaggtatgccttgtggagagccaatgctcggcgtaggttgtggttgaaccggacttggatgtggtatatcctggtcctggtgaacaacgggtcctctacatgttgtatcctgaaaaataggggatttggaacctcccaaataaaaacggaattctctgcctgacgcacagtgatgctgtccccggtgcgtgaatccatgatttgcgcagttgatgtggaggaatatagagcagccgcagtttaggtctatgcgtcgtctgcgaatagttctcttcttagcaatcctgtgctgtgcttttatagaggggagcgtggaggatgacgaattgagcatttttttgtgtccacgctctcaatgatgcattttcttctttgttgaggaaagctatatagctgctaccttcccctggattgcacagcacaattgatggtatcccgcctttaatttgaactggctttccgtatttacagttggactgccagtctttttgggccccaattagctctttccagtgctttagctttagatattggggcgtgatatcatcaatgacgttatactccacattgtttgaatagacctttgcattgaaatcaagatgaccgctcaaataattatgtgggcctaatgcacgtgcccacattgtcttgccgcttcgcgaatcaccctcaatgacaatactaatcggtctatctggccgcgcagcggaactccgaccaaaatattcagcaacccaatgttgcatatcctcaggaacgttgttaaacgaggataatggatatggaggattccatggcgtaggaggagttgtaaagaggcgctcgatgttagcctttatgttatgataactaacaatgaacgttttgggatcaccagctttgattatgtcgagcgcctcgtccgcacttgcagcatttacagcgttatagtagacgtcgtctttatttgctttggaccccccggaaactttgtactgcccagattcacaataatcaccctcttttgttatgtaatttttaacggcatttgcgtctttggctgcctgaacgtttggatgaaactgggcagacctccgggggtgagtaatgtcgaagaatcgtgcatctttgatgttgcatttcccggtcaattggattagacagtgcaagtgcgggaacccatcggaatgctcctctcgtgctacccggatgtagataggtttaaccactgaccattttaaagaacggagcatttcgatagcttcatcctttgggatatcgcattttggatatgttaagaaaatgtttttacattgtaagcgaaatgattttgtaggtagtggcatttttgcaaatatgatataggactccagcagagtccctcaacttctgtcatatattgtggagtcctggagtcccttatatacataaagcctcttggggactccaagggcaaaagcggccatcctataatatt

SEQ ID NO: 269 - DNA, 2619 bp, Pepper golden mosaic virus
accggatggccgcgattttttggagtatttgtgggaccactcagaatagagggctgagattaaatagataaagagatgggaccaccaattatttgattttgactgaccaatctcatcccggctgtcaagtctagatatttgtgccttggtgaccaaggtgtggtcctataaatgcacgtgcatgtgcatttatatctttaattcaaaatggttaagcgggatgccccatggcgtttaatggcggggacctccaaggtttcccgctctgctaattattcacgtggcacgggtatgggccctaaattcgataaggccgctgcttgggttaacaggcccatgtacaggaagcccaggatatatcggacctttagaagcccggatgttcctagaggttgtgaagggccttgtaaggtccagtcatttgagcagcggcatgatatctctcatgttggcaaggtcatgtgcatttcggacgtgacacgtggtaatggtattactcatcgtgtagggaagcgtttctgtgtcaagtctgcatatgttttgggtaagatctggatggacgagaatatcaagctcaaaaaccacaccaacagcgtcatgttctggcttgtgcgagataggagaccatatggtacccctatggatttcgggcaggtgttcaacatgtatgacaacgagcctagtacagccactgtgaagaacgatctgcgtgatcgttaccaagttatgcacaggttctcagctaaggtcacaggtggacagtatgccagcaacgagcaggcgttggtgagacgattttggaaagtgaacaactacgtcgtctacaaccatcaggaagctggcaaatatgagaatcatactgagaacgccctcttattgtatatggcatgtactcatgcatctaaccctgtgtacgcgacattgaaaattcgaatctatttctacgattcgataacaaattaataaagtttgtattttatttcatgattctcaagtacataatttacataggatttgtccgtcgcaaaacgaacagctcgaattacattgtttatgcctatggcccctagcctatgtaaatacaacatgacgcgaaatttgaatctatttaaatatgtcgtcccagaagctgtcatcgaagtcgtccagacttggaaatggaggaatgccttgtggagagccaatgctctgcgtaggttgtggttgaaccgtacttcgatgtggtaaatcctggttctggtgtacaacggcgtctctactcgttgtatcctgaaaaataggggatttggaacctcccaaataaaaacggaattctctgcctgacgcacagtgatgctctccccggtgcgtgaatccattatttgcgcagttgatatggaggaaaatagagcagccgcagtttaggtctattcgtcgtcttcgaataactcgttttttagctatcctgtgctgtgcttttatagaggggagcgtggaggatgacgaattgagcatttttttgtgtccacgctctcaatggtgcattttcctctttgttgaggaaagctatatagctgctaccttcccctggattgcacagcacaattgatggtatcccgcctttaatttgaactggctttccgtatttacagttggactgccagtctctttgggccccaattagctctttccagtgtttcaactttagataatggggcgtgatatcatcaatgacgttatactccacatcgtttgaatagacttttgaattgaaatcaaggtgaccgctcaaataattatgtgggcctaatgcacgtgcccacattgtcttgccgcttcgcgaatcgccctcaatgacaatactaatcggtctatctggccgcgcagcggaactccgaccaaaatattcagcaacccaatgttgcatatcctcaggaacgttattaaacgaggaaattggataaggaggagtccattgtttaggaggaggtttgaacaggcgctcgatgttagacttaacgttatgatagctgacaatgaacgttcttggatctccagcttttataatgtcgagcgcctctgtcgcacttgctgcatttacagcgttatggtagacgtcgtctttatttgctttggaacccccggaaactttgtactttccagtttcacaataatcgccatctttagtgatataattctttacggcatttgtgtctttagccgcctgaacgtttggatgaaactgggcagatctccgggggtgagtaatgtcgaagaaccgagcgtctttgatgttgcactttccagttagctggattagacagtgcaagtgcggaaacccatcggaatgctcctcccgtgaaacccgtatgtatatgggttttacgacagaccattttaacgactgtagcatttcgagagtttcatcctttgggatatcgcattgtggatatgttaagaaaatgtttttacattgtaaacgaaatgattttggtggtagtggcattttcgcaaatatggtgtaggactccagcagagtacctcataaaaccgtactatgtttgtggagtcctggagtcccttaaatactagaactctctgggggaactccaggggcaaaagcggccatcctataatatt

SEQ ID NO: 270 - DNA, 8897 bp, Tomato spotted wilt virus
agagcaatcaggtaacaacgattttaagcaaacatgaacatccagaaaatacaaaaattaatagaaaatggaaccactttactgttgtctattgaggattgtgtaggttctaaccacgatctagctttggatttacataagagaaatagtgatgagatcccagaagatgtgattataaataataatgcaaaaaattatgagacaatgagagagttaattgtcaaaatcactgctgatggtgaaggactaaacaaagggatggcaactgtggatgtcaaaaagctaagtgagatggtctctctgtttgagcaaaaatacctagaaacagagttagcaaggcatgacatttttggagagctgatctccaggcacctgagaataaagcccaaacaaagaaatgaagtggagatagagcatgcactaagagaatatctggatgaactcaacaaaaagtcctgcattaacaagctctctgatgatgagtttgagagaataaataaagaatatgtagcaactaatgccacccctgataactatgtgatatataaagaatcaaaaaacagtgagctttgtttaatcatttatgattggaaaatatctgtcgatgccaggactgaaaccaaacaatggagaaatacctacaagaatatttggaaatctttcaaagatataaaagtgaatggaaagccattcctggaagagcatcctgttttcgtttctatagttatattgaaacctattgctgggatgccaatcactgttactagtagcagggttttggagaaattcgaagattctccatcagcattgcacggagaaagaataaagcatgctaaaaatgccaaattgctaaatatttcttatgttgggcaaatagttggaaccacacccacagtggtgagaaactattatgcaaacactcaaagaatcaaatctgaagtcagaggaatcttaggtgatgattttggatctaaagatgtgtttttcagtcactggaccagcaaatacaaagaaagaaatcctactgagatagcctattccgaagatattgaaagaataattgattcacttgttacagatgaaatccctagagaggaaataatacattttttgtttggaaatttctgtttccacattgaaacaatgaatgaccagcatatagctgacaaatttaaagggtaccaaaactcttgtatcaatttaaaaatagagccaaaagctgatttagctgatttgaaagaccacttaatccaaaagcagcaaatatgggaatctctgtatggaaaacaccttgagaagatcatgcttagaattagagaaaaaaagagaaaagaaaaagagatacctgacataaccacagcttttaaccagaatgctgctgaatatgaagaaaggtatcctaactgtttcaatgatctctctgaactaaaactaactttccatgacttggtccccagtttgaagatagaattgagctcagaggtagattacaacaacgcaattattaacaagtttcgggagagcttcaaaagttcttcaagggttatttataatagcccatatagtagcataaataaccaaacaaataaagcaagagatataacaaacttagttagactgtgtttagcagagctaagttgtgatacaacgaaaatggaaaagcaggaacttgaagatgaaatagatataaacaccgggagtatcaaagttgagagaacaaaaaagtctaaagaatggaataagcaaggttcgtgtttaaccagaaacaaaaatgaattttgcatgaaagatacaggcagggagaacaaaactacctattttaaaggcttagcagtaatgaatataggaatgagttctaagaaaagaattctaaaaaaagaagaaataaaagaaaggatctctaaaggcttggaatatgatacctctgaaaggcaggctgacccaaatgatgattactcaagtatagacatgtcttctctgactcatatgaaaaaactgataaggcatgacaatgatgatagcttaagtggtaaaagatttaagggctctttttttctacttcataattttaatataatagaggatggtaagatcacatctgttttcaataattatgctaaaaatcctgaatgcttgtacattcaagattcagtactgaagactgaattagagacttgcaaaaagataaacaaattatgcaatgatctagccatttaccattactctgaagacatgatgcaattctccaaaggtttaatggtggctgacaggtacatgactaaagaaagtttcaagatattaaccacagcaaatactagcatgatgctattagcattcaaaggggatggaatgaacaccggaggatcgggagttccttacatagcattgcatatagtggatgaagacatgtcagatcattttaacatatgttatactaaagaaatttatagctatttccgaagtggtagtaattacatttatataatgaggccgcagagactaaaccaggtgaggctgctgaggcttttcaaaacgcctagtaaagttcctgtatgttttccacaattttcaaagaaagctaatgaaatcggaaaatcgctgaaaaataaagatatagaaaaagtaaatctcttttctatgacaatgactgtaaaacagatattaataaatattgtgttttcatctgtcatgataggaactgtgacaaagctcagtagaatgggaatttttgatttcatgcggtatgcaggttttttgcgactatccgattattctaacataaaagaatacattagagacaaatctgatcctgatataactaactgtggcagatatctatttcgtaatggaatcaaaaaactattgttcagaatggaagatctcaatttaagcacaaatgccaagcctgttgttgtggaccacgaaaatgatattataggagggataacaaacttgaatataaaatgtcctataacaggatcaactctactgacacttgaggacctgtacaataatgtttatttggctatttatatgatgcctaaatcactgcacaatcatgttcacaatctaacaagcttattaaatctccctgctgagtgggagctaaagttcagaaaagaattaggtttcaacatatttgaagacatataccctaagaaagcaatgtttgatgacaaagacctattctccataaatggagctttgaacgtgaaagcattatctgattactatctaggaaatatagaaaatgttggtttaatgagatcagaaatagaaaataaagaagatttcctaagcccttgttataaaatatctactttaaaatcttcaaaaaaatgctcacaatcaaacattataagtactgatgagataatagagtgtcttcaggatgcaaagattcaagatatagaaaattggaaaggaaataacctagctattataaaagggcttataagaacctacaatgaggagaaaaatagattggtggaattttttgaagataattgtgtcaattcattatatcttatagaaaagcttaaagagataattagtagtggatcaataactgtagggaaatctgtaacatctaaattcataagaaacaatcatcctttaacagtagaaacatatctcaaaacaaaactatattatagaaataatgtaacagttttaaagtctaaaaaagtgtcagaggagctctatgaccttgtaaaacagttccatgacatgatggaaatagacctagattctgttatgaacctcgggaaaggtacagaaggaaaaaaactcacattcttgcagatgcttgaatttgtcatgtccaaggctaaaaatgtcaccgggtctgtagattttctagtttctgtttttgaaaaaatgcagagaaccaaaacagacagagaaatatacttgatgagcatgaaagtgaaaatgatgctttattttatagagcatacattcaaacatgtagcgcagagtgatccatcggaagccatatctataagtggagacaataaaataagagcactttctacgttatctttggacacaatcacgtcttacaatgatattttaaacaaaaattcaaagaagtcaagattggctttcctatctgcagatcagtcgaaatggtcggcatcaggccttaccacctataaatatgttttagctatcatattaaatccaattttaactactggtgaagctagcttaatgatagaatgcatcttaatgtatgttaaattgaagaaggtttgtataccaacagatatttttttgaatctaagaaaagctcaacaaacttttggggaaaatgaaactgccataggacttttgaccaaaggcttgacgacaaacacataccctgttagcatgaattggttgcaaggcaatttaaattatctgtcttctgtttatcactcttgtgcaatgaaagcttatcacaacactttggaatgttacaaaaactgtgatttccaaactagatggattgtgcactctgatgataatgcaacatcattaatagccagtggagaggttgataaaatgctgacagacttttcaagctcatctctgccagaaatgttgtttagaagcattgaagctcatttcaaaagtttttgcataactttgaacccaaaaaagagttatgcttcttcatcagaagtagagtttatatctgaaagaattagtaaatggagcgattattcctctctattgcaggcatttagcaaactgttgcacagaatcttcgcatataagttatttgatgatctaatgtcactcagtatacatgttacaatgcttctgagaaaaggctgtcctaatgaagttataccttttgcttatggggctgtgcaggtacaagcgttaagcatctattcaatgcttcctggtgaagtgaatgatagtattagaatttttaacaagcttggagtaagtttaaagtcaaacgagattcccacaaacatggggggctggttgacctctcctatagagccgttgtctatattaggtccatcatcaaatgatcaaatcatctattacaatgtgataagagattttttgaacaaaaaaagtttagaagaagtaaaagatagtgtctcttcttccagttatctacagatgagattcagagagctaaaagaaaagtatgaaagaggaactctggaagaaaaagataaaaagatgatatttcttatcaatctgtttgagaaagcatcagtgtctgaagattcagacgttctaacaattgggatgaaatttcaaactatgttaactcagattataaaattacctaattttataaatgagaatgctttaaacaagatgtcaagttataaagatttttcaaaactttatcctaatttaaaaaagaatgaagatttatataaaagcactaagaacttaaagatagacgaggatgctgttttagaggaagatgagttatataagaagattgcatctagcttagaaatggaatctgtccatgacataatgataaaaaatcctgaaacaattctgatagcaccattgaatgatagagattttttacttagtcagctgttcatgtacacaagcccttctaaaagaaaccagttatcgaaccaatctacagagaaacttgctttagatagagtgttaaggtcaaaagctagaacatttgtaaacatttcttccactgtgaagatgacttatgaagaaaacatggaaaagaaaatcttagaaatgctaaaatttgatttagattcatattgttcatttaaaacatgtgtaaatctagttatcaaggatgttaatttcagcatgctgattccaatattagattctgcatacccttgtgaatctaggaaaagagataactacaatttcaggtggtttcagactgagagatggatacctgttgttgaaggctctccgggactagtagtaatgcatgctgtctatggatcaaattatatagagaacttaggtttaaaaaacatccctctaacagacgatagtattaatgttttaacaagcacgtttggaacaggtttaatcatggaagatgtaaaatccctagttaatggcaaagacagcttcgaaacagaggcttttagcaattctaatgaatgtcaaagattggtgaaagcatgcaattatatgatagcagcacaaaacaggcttttagcaattaacacatgctttactaggaaaagctttcccttctattctaagttcaatctagggagagggtttatctcaaacacattagctctcctatccaccatctacagtaaagaagaatcctatcattttgtttctacagctagttataaattagacaaaactatcagaactgtggtaagtgctcagcaagatatgaacttagagaaaatactggacactgctgtatacatatcagataaattgcagtcacttttcccaacaattacaagagaggatatagttttaatattgcaaaatgtttgccttgacagtaaacctatatggcagagtctagaagacaaaatgaaaaagattaacaattcaacagcaagtggcttcacagtgtcaaatgtgattctatcacataacagtgaattgaacacaatccagaaacaaattgtctggatgtggaacatgggtttgtgttctcacagaacattagattttgttatcaggtatattagaagaagggatgtaagatatgtaaaaactgaagaacaagatgaatcaggaaattatgtctctggaactatgtacaaaatagggatcatgacaagaagctgctatgtggaattgatagcatctgatcaagatgtagcagtttctttgagaacaccatttgagatattgaatgaaagagagtatctttttgacacatacagagaaagtatagagaaattattggcagaaattatgtttgataaagtgaacataataaatcaaacaaccacagattgttttcttagaaccaggagatcttgcatcagaatgaccacagacaacaaaatgattgtaaaggttaatgctacatcaagacaaataagactagagaatgtaaaattagttgtaaagataaaatatgaaaatgtgaattccgatgtatgggatattatagaaagccaaaaatctctagtcttaaggctccctgaagtaggggaatttttctctgatatgtataaaactgcagactctgaaactgaaacaatcaaaaccataaaaaacaggcttatgacttctttaactttcatagaagcctttggaaacttatcacagcagatcaaagagattgtagatgatgatatcagagaaacgatggatgaattcttaatgaacatccgggatacctgcttagaaggtttggaaaactgcaaaagtgtggaagaatatgatagctatcttgatgaaaatggatttaatgacacagtagaactattcgaaaacttgctaagaacacatgacaactttgaaaatgagtatagtcctcttttttcagagattgttgacaaagcaaaacagtatactagagatttagaaggtttcaaagaaatactgctcatgcttaaatattctctaataaatgatgcatcaggatttaaaagctatagagccactggaatgcatgctgttgagctaatggcaaaaaagcacatagagataggggaattcaacttgttaggaatgatccaattgattaaagcttgtgaaacatgccacaacaatgactctatattaaacttagcaagtttaaggaatgttcttagcaggacatatgccacatttgggaggagaataagattggatcatgatctggacttgcaaaacaacttaatggaaaaaagttatgatttcaagacgctggttttaccagaaataaaattatcagaactatctagggaaatactgaaagaaaatgggtttgttatatctggagagaatctaaaaatggataggtctgatgaagaatttgtgggtcttgccagttttaatgtgttgaggctagatgaggaagaaatgtatgaaggtttgatcaaagaaatgaaaattaaaaggaaaaagaaagggtttttatttccagcaaacacacttctactaagtgagttgataaagttcttgattggaggaataaagggaaccagctttgatatagagacattgttacggaacagttttagaccagacatattttcaactgacagattgggaagattaagttccagtgtacctgcactcaaagtttatgcaactgtttatatggaatataagaatgtcaattgtcctttaaatgagatagctgacagcttagaaggttatctaaaactgacaaaaagcaggtccaaggaacatttcttgtctggaagagttaaaaaagctttgatacaattaagagatgaacaatcgcgaactaaaaaactagaggtctataaggatatcgcaaatttccttgctaggcacccactatgtttatcagaaaaaacattgtatggaagatatacctactctgatatcaatgattatatcatgcaaacaagagagattattttgagtaaaataagtgagttggacgaggttgttgaaacagatgaagacaatttcttgcttagttatctaagaggggaagaagatgcctttgatgaagatgagcttgatgaagaagaagacacagattaaattgaaagtaatgactaacaatccatgaataacagattagatataacttagaatataaatttattgctattttagaattagattagatctacttagcctaaaacaatttggtgaaccaaatctatagtgtatataaatgtagagtcccggtatagtttcactggagggaattcttatgtaatttgtaaagtctggctgtggagaggttatatgttttagttgtacctgattgctct

SEQ ID NO: 271 - DNA, 8897 bp, Tomato spotted wilt virus; identical to SEQ ID NO: 270

SEQ ID NO: 272 - DNA, 8917 bp, Tomato spotted wilt virus
agagcaatcaggtaacaacgattttaagcaaacatgaacatccagaaaatacagaaattaatagaaaatggaaccactttattgttatctattgaggattgtgtaggttctaaccatgatctggctttggatttacataagagaaatagcgatgagattccagaagatgtgattattaataataatgcaaaaaactatgagacaatgagagaattaatcgtcaaaatcactgccgatggagaagggctaaacaaagggatggcaactgtggatgtcaagaagctgggtgagatggtctctctgtttgagcaaaaatacctagaaacagagttagcaaggcatgatattttcggagagctgatctccaggcacctgagaataaaacccaaacaaagaagcgaggtggagatagagcatgcactcagagaatatctggatgagctcaacaaaaaatcctgtgttaacaagctctctgatgatgagtttgagagaataaacaaagaatatgtggcaactaacgccacccctgataactatgtaatatataaagaatcaaaaaacagtgaactttgtttaatcatttatgattggaaaatatctgtcgatgccaggactgaaaccaaaacaatggaaaaatactacaaaaatatctggaaatctttcaaagatataaaagtgaatggaaagccattcctagaagatcaccctgttttcgtttctattgttatattgaaacctattgctgggatgccaatcactgttactagcagcagggttttggggaaatttgaagactctccatcagcattgcatggagaaagagtaaagcatgctagaaatgctaaactgctgaatatttcttatgtcggacaaatcataggaaccacacccacagtggtgagaaactattacgcaaacactcagaaaatcaaatctgaagtcagagggatcttaggtgatgattttggatccaaagatgtgttttttagtcattggactagcaaatataaagagagaaatcttactgaaatagcctattctgaagatattgaaagaataattaactcacttgttacagaagaaatccctagggaagaaataatacattttttgtttgggaatttctgtttccacattgaaacgatgaatgaccagcatattgctgacaaatttaaagggtaccaaaactcttgtattaatttaaaaatagagccgaaagctgatttagctgatttgaaagaccacttaattcaaaaacagcaaatatgggaatctttgtacgggaaacaccttgagaagatcatgcttagaattagagaaaaaaagaaaaaagagaaagaaatacctgacataactacaacttttaaccagaatgccatagaatatgaagaaaagtaccctaactgttttacaaacgatctttctgaaactaaaactaacttttccatgacttggtccccaagttttgaaaaaattgaattgagctcagaagtagattacaataatgcaatcataaacaaatttcgggaaagcttcaaaagttcttcaagaattatttacaatagcccatatagtagcataaataaccaaacgaacaaagcaagagatataacaaacttggttagactgtgtttaacagagctaagttgtgatacaacaaaaatggaaaaacaggaactcgaggacgaaatagatataaacactgggagcattaaagttgagagaacaaagaaatctaaagaatggagtaagcagggttcatgtctgactaggaacaaaaatgaattttgtatgagagagacaggcaaggagaacaagactacctattttaaaggtttagcagtaatgaatataggaatgagctctaagaaaagaattctaaaaaaagaagaaataaaagaaaggatttctaaaggcttggaatatgatacctcagaaaggcaggctgacccaaatgatgattattcaagtatagacatgtcttctctgactcatatgaaaaaactaattaggcatgacaatgaggacagcttaagctggtgtgaaagaattaaggattctttgtttgttcttcataatggtgatataagagaggaaggcaagatcacatctgtttacaataattatgctaaaaatcctgaatgcttgtacattcaagattcagtactgaaagctgaactagagacttgtaagaagataaacaaattatgcaatgacctagccatttaccattactctgaagacatgatgcaattctccaaaggtttgatggtggcagacaggtatatgactaaagaaagtttcaagatactaactacagcaaatactagcatgatgctactggcattcaaaggagatggaatgaacaccggaggatcgggagttccttacatagcattgcacatagtggatgaagacatgtcggatcaatttaacatatgttacactaaagagatttatagctatttccgaagtggtagtaattacatttatataatgagaccgcagagactcaaccaggtgaggttgctgagccttttcaaaacgcctagtaaagttcctgtatgttttgcacaattttcaaagaaagctaccgaaatggaaaaatggctgaaaaacaaagatatagaaaaagtgaatgtcttttctatgacaatgactgttaaacagatattaataaatattgtgttctcgtctgtcatgataggaactgtgacaaagctcagcaggatgggaatttttgatttcatgcggtatgcagggtttttaccactgtctgattattctaatataaaagaatatattagagataaattcgatcctgacataactaactgtggcagatatctatttcgtaatggaatcaaaaaactattgttcagaatggaagatctcaatttaagcacaaatgccaagcctgttgtcgtagaccacgaaaacgatattataggaggtataacaaacttgaatataaaatgtccaataacaggatcgactctactgacacttgaagatttgtacaataatgtttatttggctatttatatgatgcctaaatcattgcacaatcatgttcacaatctaacaagtttgttaaatgtccctgctgagtgggagctaaagttcagaaaagagttaggtttcaacatacttgaagacatataccctaagaaagcaatgtttgatgacaaagacctattctctataaacggagctctgaatgtgaaagcattatccgattactatctggggaatatagaaaatgttggtttgatgagatcagaaatagaaaataaagaagattttctaagcccttgttacaagatatctactttaaaatcttcaaaaaagtgctcacaatcaaacattataagtactgatgagataatagagtgtcttcagaatgcaaagattcaagatatagaaaactggaaagggaataatttggctattataaaagggcttataagaacttacaatgaggagagaaatcgactagtggaattctttgaagataattgtgtcaattcgttgtatcttgtagaaaagcttaaagagataattaatagtggatcaataactgtagggaaatctgtaacatccaaattcataagaaataaccatccattaacagtggaaacatatctcaaaacaaaactatattatagaaataatgtaacagttttaaagtctaaaaaagtgtcagaggagctttatgaccttgtaaaacagtttcataacatgatggaaatagacttagattctgttatgaaccttggtaaaggtacagaagggaagaaacacacattcttgcagatgcttgaatttgtcatgtccaaggctaaaaatgtcaccgggtctgtagattttttagtttctgtttttgaaaaaatgcagagaactaaaacagacagagaaatatacttgatgagcatgaaagtgaaaatgatgctttactttatagagcacacattcaaacatgtagcacagagtgatccatcggaagctatctctataagtggagacaataaaataagagcactttctacgttatctttggacacaatcacgtcttacaatgatattttgaacaaaaattcaaagaagtcaagattggctttcttatctgccgatcagtcgaaatggtcggcatcagaccttaccacctataaatatgttttagctatcatattaaatccaattttaactaccggtgaagctagcttgatgatagaatgcattctaatgtatgttaaattgaaaaaggtttgtataccaacagatatttttttgaacctaagaaaagctcaaggaacttttgggcaaaatgaaactgccataggacttttgactaaaggtttgacgacaaacacatacccggttagcatgaactggttgcaaggcaatttaaattatctgtcgtctgtttatcattcttgtgcgatgaaagcttatcacaagactctagaatgttacaaagactgcgatttccaaactagatggattgtgcactctgacgacaatgcgacatcactgatagccagtggagaggtcgataaaatgctaacagatttttcaagctcatctctgccagaaatgttgtttagaagcatagaagctcatttcaaaagcttttgcataactttgaaccctaaaaagagttatgcttcttcatcagaagtagagtttatatctgaaagaattgtaaatggagcaattattcctctctattgcagacatttagcaaattgttgcacggaatcttcacatataagttattttgatgatttgatgtcactcagtatacatgttaccatgcttttaaggaaaggctgtcccaatgaagtaataccttttgcttatggagctgtgcaagtacaagcattaagtatctattcaatgcttcctggtgaagtaaatgatagcattaggatttttaaaaaacttggagtaagtttaaaatcaaacgagattcccacaaacatggggggctggttaacttctcctatagagccattgtctatattgggtccatcatcaaatgatcaaatcatctattacaatgtgataagagattttttgaacaaaaaaagtttagaagaagtcaaagatagtgtctcttcttctagttatctacagatgagattcagagagttaaaagaaaagttgaaaagaggagctctggaagaaaaagacaaaaagatgatatttcttattaatttgtttgagaaagcatcagtgtctgaagattcagacgttctaactatcgggatgaaatttcaaaccatgttaactcagattataaaattgcctaatttcataaatgagaatgctttaaacaagatgtcaagttataaggatttttcaaaactttaccctaatctaaaaaagaatgaagatctatataaaagtaccaagaacttgaagatagacgaggatgctgttttggaggaagatgagttatatgagaagattgcgtctagcttagaaatggagtctgtccatgacataatgataaaaaatcctgaaacaattctgatagcaccattgaatgatagggattttttacttagtcagctgtttatgtacacaagcccttccaaaaggaatcaattgtcaaaccaatctacagagaaacttgctttagatagggtattaaggtcaaaagctagaacatttgtagacatttcttctactgtgaagatgacttatgaagaaaacatggaaaagaaaatcttagaaatgctaaaatttgatttagattcgtattgttcattcaaaacatgtgtaaatctagtaatcaaggatgttaatttcagcatgctgattccaatattggattctgcatacccttgtgaatctagaaaaagagataattacaatttcaggtggtttcagactgagaaatggatacctgttgttgaaggctctccaggactagtagtgatgcatgctgtttatggatcaaattatatagaaaatttgggtttaaaaaacatccctctaacagacgatagcattaatgttttaacaagcacatttggaacaggtctaatcatggaagatgtgaaatccctagttaaaggtaaagacagcttcgaaacagaggcttttagtaattctaatgaatgtcaaagattggtgaaagcatgcaactatatgatagcagcacaaaacaggcttttagcaattaacacatgctttactaggaaaagcttccctttctattccaagttcaatctagggagaggatttatttcaaacacactagctctcctatccaccatctacagcaaagaggaatcctatcattttgtttctacagctagttataagctagacaaaaccatcagaactgtgataagcgctcagcaagacatgaacttagagaaaatactggacactgctgtatacatatcagataaattgcagtcacttttcccaacaattacaagagaagatatagctttgatattacaaaatgtgtgccttgacagcaagcctatatggcagagtctagaagacaaaatgaaaaggattaacaactcaacagcaagtggcttcacagtatcaaatgtgatcctatcacataacagtgaattgaacacaatccagaaacaaattgtctggatgtggaacatgggtttgtgttctcatagaacattagattttgttatcagatatattagaagaagtgatgtaagatatgtgaaaactgaagaacaagacgaatcaggaaattatgtctctggaacaatgtacaaaattggggtcatgacaagaagctgttatgttcaattgatagcttctgatcaggatgtagcagtttctttgagaacaccattcgagatattgaatgaaagagagtatctttttgatacatacagagaaagtatagagaaattgttgcagaaatttatgtttgataaagtgaacataataaagtcaaaacaaccacagattgttttcttagaaccaggtgatgcctgcattagaatgactacagacaacaaaatgattgtcaaggttaatgccacgtcaggacaaataagactagagaatgtaaaattagttgtgaagataaaatatgaaaatgtgaaccccgatgtatgggatattatagaaggccaaaagtctctagtcttgaggcttcctgaagtaggggaatgtttctctgatatgtacaaaactgcagactctgaaactgaaacaatcaaaaccataaaaaacaggctcatgacctctttaactttcatagaagcctttggaaacttatcacagcagatcaaagagattgtagatgatgatatcagaggaacgatggatgagttcttaatgaacatccgagatacctgcttagaaggcttggaaaactgcaaaagtgtagaagaatatgataagtatcttgatgaaaatggttttaatgacacagtggaactattcgaaaacttgctaagaacacatgataactttgaagatgagtatagtcctctgttttcagagattgttgataaagcaaaacagtacactagagatctggaaggtttcaaagaaatactgctcatgcttaaatattctctgatcaatgatgcatcaggatttaaaagctatagagccactggaatgcatgctgttgaactaatggcaaaaaaacacatagagataggggaattcaacttgttaggaatgattcaactgattaaagcttgtgaaacatgccacaacaatgactctatattaaacttagcaagtttgaggaatgttcttagcagaacatatgccacattcgggaggggaataagattgaaccatgatctggacttgcaaaacaatttaatggaaaaaagttatgatttcaagacgctggttttaccagacataaaattatcagaactatctagggaaatactgaaagaaaatgggtttgttatatctggagagaatctaaaaatggataggtctgatgaagaatttgagggtcttgctagttttaatgtgttgaggctagatgaggaagaaatgtatgaagggttgatcaaagaaatgaaaattaaaaggaaaaagaaagggtctttattcccggcaaatacacttctactaagtgagttgataaaattcttgattggagggataaagggaaccagttttgatatagagacattgttgcggaacagttttagaccagacatattttcaactgacagattgggtaggttgagttccagtgtacctgcactcaaagtttatgcaactgtttatatggaatataagaatgtaaattgtcccttaaatgagatagctgacagcttggaaggttatctaaaactgacaaaaagcaagtctaaagagcatttcttacatggaagagtcaagaaagccttgatacaattaagagatgaacaatcacgaacaaaaaaattagaggtttatagagatatcgcaaattttctttccagacatccactatgtttgtcagagaaaaccttgtatggaagatacacctactctgatatcaatgattatatcatgcaaacaagagagattattttgagtaaaataagtgagttggatgaggttgctgaaacagatgaagacaatttcttgcttagttatctaagaggagaagaagatgcctttgatgaagatgaaattgatgaagaaggagacacagattaaattaatagtaatgcccaacaatgcatggataatggattagatagaacttagaatacaatttttttgttattttagaattaggttagatctgattagcctaaagacaatttggtgaaccaaatctatagtatatgtaaatgtagagtcccggtatagtttcactggagggaattcttatataatttatttgtaaagtctggttatggagagattatatgttttagttgtacctgattgctct

SEQ ID NO: 273 - DNA, 8913 bp, Tomato spotted wilt virus
agagcaatcaggtacaactaaaacatataatctctccataaccagactttacaaataaattatataagaattccctccagtgaaactataccgggactctacatttacatgcactatagatttggttcaccaaattgtctttaggctaatcagatctaacctaattctaaataacaaaaaatttgtattctaagttctatctaatccattatccatgcattgttgggcattactattaatttaatctgtgtcttcttcttcatcaatttcatcttcatcaaaggcatcttcttctcctcttagataactaagcaagaaatcgtcctcatctgtttcaacaacctcatccaactcacttattttactcaaaataatctctcttgtttgcatgatataatcattgatatcagagtaggtgtatcttccatacaaggttttctctgacaaacatagtggatgtctggaaagaaaatttgcaatatctttataaacccctaattttttagttcgtgattgttcatctcttaattgtatcaaggctttcttgactcttccatacaagaaatgctccttagacttgctttttgtcagttttagataaccttccaagctgtcagctatctcatttaagggacaatttacattcttatattccatataaacagttgcataaactttgagtgcaggtacactggaacttaacctacccaatctgtcagttgaaaatatgtctggtctaaaactgttccgcaacaatgtctctatatcaaaactggttccctttatccctccaatcaagaattttatcaactcacttagtagaagtgtatttgccgggaataaaaaccctttctttttccttttaatcttcatttctttgatcaaaccttcatacatttcttcctcatctagcctcaacacattaaaactagcaagaccctcaaattcttcatcagacctatccatttttagattctctccagatataacaaacccattttctttcagtatttctctagatagttctgataattttatgtctggtaaaaccagcgtcttgaaatcataacttttttccattaaattgttttgcaagtccagatcatggttcaatcttattctcctcccgaatgtggcatatgtcctgctaagaacattcctcaaacttgctaagtttaatatagagtcattgttgtggcatgtttcacaagctttaatcagttggatcattcctaacaagttgaattcccctatctctatgtgtttttttgccattagttcaacagcatgcattccagtggctctatagcttttaaatcctgatgcatcattgatcagggaatatttaagcatgagcagtatttctttgaaaccttccaaatctctagtgtactgttttgctttatcaacaatctctgaaaacagaggactatactcatcttcaaagttatcatgtgttcttagcaagttttcgaatagttccactgtgtcattaaaaccattttcatcaagataattatcatattcttctacacttttgcagttttccaaaccttctaagcaggtatcccggatgttcattaagaattcatccatcgtttctctgatatcatcgtctacaatctctttgatctgctgtgataagtttccaaaggcttctatgaaagttaaagaggtcatgagcctgttttttatggttttgattgtttcagtttcagagtctgcagttttgtacatatcagagaaacattcccctacttcaggaagcctcaagactagagacttttggccttctataatatcccatacatcggagttcacattttcatattttatcttcacaactaattttacattctctagtcttatttgtcttgatgtggcattaaccttgacaatcattttgttttctgtagtcattctaatgcaggcatctcctggttctaagaaaacaatctgtggttgttttgactttattatgttcactttatcaaacataaatttctgcaacaatttctctatactttctctgtatgtatcaaaaagatactctctttcattcaatatctcgaatggtgttctcaaagaaactgctacatcctgatcagaagctatcaattgaacataacagcttcttgtcatgatcccaattttgtacattgttccagagacataatttcctgattcgtcttgttcttcagttttcacatatcttacatcacttcttctaatatatctgataacaaaatctaatgttctatgagaacacaaacccatgttccacatccagacaatttgtttctggattgtgttcaattcactgttatgtgataggatcacatttgatactgtgaagccacttgctgttgagttgttaatccgtttcattttgtcttctaaactctgccatattggcttgctatcaaggcacacattttgtaatatcaaaactatgtcttctcttgtaattgttgggaaaagtgactgcaatttatctgatatgtatacagcagtgtccagtattttctctaagttcatgtcttgctgagcgcttatcacagttctgatggttttgtctagtttataactagctgtagaaacaaaatgataggattcctctttgctgtagatggtggataggagagctagtgtgtttgaaataaatcctctccctagattgaacttggaatagaaagggaagcttttcctagtaaagcatgtgttaattgctaaaagcctgttttgtgctgctatcatatagttgcatgctttcaccaatctttgacattcattagaattactaaaagcctctgtttcaaagctgtctttacctttaactagggatttcacatcttccatgattagacctgttccaaatgtgcttgttaaaacattaatgctatcgtctgttagagggatgttttttaaacctaaattttctatataatttgatccataaacagcatgcatcactactagccccggagagccttcaacaacaggtatccatttttcagtctgaaaccacctgaaattgtaattatctctttttctagattcacaagggtatgcagaatccaatattggaataagcatgctgaaattaacatctttgattaccagatttacacatgttttaaatgagcaatacgaatctaaatcaaattttagcatttctaagattttcttttccatgttttcttcataggtcatcttcacagtggaagaaatgtccacaaatgttctagcttttgaccttaataccctatctaaagcaagtttctctgtagattggttcgataattgattccttttggaagggcttgtgtacataaacagctgactaagtaaaaaatccctatcattcaatggtgctatcagaattgtttcaggattttttatcattatgtcatggacagactccatttctaagctagacgcaatcttctcatataactcatcttcctccaaaacagcatcctcgtctatcttcaagttcttggtacttttatatagatcttcattcttttttagattagggtaaagttttgaaaaatccttataacttgacatcttgtttaaagcattctcatttatgaaattaggcaattttataatctgagttaacatggtttgaaatttcatcccgattgttagaacgtctgaatcttcggacactgatgctttctcaaacaaattaataagaaatatcatctttttgtctttttcttccagagttcctctttcatacttttcttttaactctctaaatctcatctgtagataactagaagaagagacactatctttgacctcttctaaactttttttgttcaaaaaatctcttatcacattgtaatagatgatttgatcatttgatgatggacctaatatagacaacggctctataggagaagttaaccagccccccatgttcgtgggaatctcatttgattttaaacttactccaagttttttaaaaatcctaatgctatcattcacttcaccaggaagcattgaatagatgcttaatgcttgtacttgcacagccccataagcaaaaggtattacttcattgggacagcccttcctcaaaagcattgtaacatgtatactgagtgacatcaaatcatcaaaataacttatatgtgaagattccgtgcaacagtttgctaaatgtctgcaatagagaggaataattgctccatttacaattctttcagatataaactctacctctgatgaagaagcataactctttttagggttcaaagttatgcaaaagcttttgaaatgagcttcaatgcttctaaacaacatttctggcagagatgggcttgaaaaatctgttagcattttatcgacctctccactggctatcaatgatgtcgcattgtcatcagagtgcacaatccatctagtttggaaatcgcagtctttgtaacattctagagtcttgtgataagctttcatcgcacaagaatgataaacagacgacagataatttaaattgccttgcaaccagttcatgctaaccgggtatgtgtttgtcgtcaaacctttagtcaaaagtcctatggcagtttcattttgtccaaaagttccttgagcttttcttaggttcaaaaaaatatccgttggtatacaaacctttttcaatttaacatacattagaatgcattctatcatcaagctagcttcaccagtagttaaaattggatttaatatgatagctaaaacatatttataggtgaggtctgatgctgaccattttgactgatcggcagataagaaagccaatcttgacttccttgaatttttgttcaaaatatcattgtaagatgtgattgtgtccaaagataatgtagaaagtgctcttattttattgtctccacttatagagatagcttccgatggatcactctgtgctacatgtttgaatgtgtgctctataaagtaaagcatcattttcactttcatgctcatcaagtatatttctctgtctgttttagttctctgcattttttcaaaaacagaaactaaaaaatctacagacccggtgacatttttagccttggacatgacaaattcaagcatctgcaagaatgtgtgtttcttcccttctgtacctttaccaaggttcataacagaatctaggtctatttccatcatgttatgaaactgttttacaaggtcataaagctcctctgacacttttttagactttaaaactgttacattatttctataatatagttttgttttgagatatgtttccactgttaatggatggttatttcttatgaatttggatgttacagatttccctacagttattgatccactattaattatctctttaagcttttctacaagatacaacgaattgacacaattatcttcaaagaattccactagtcgatttctctcctcattgtaagttcttataagcccttttataatagccaaattattccctttccagttttctatatcctgaatctttgcgttctgaagacactctattatctcatcagtacttataatgtttgattgtgagcacttttttgaagattttaaggtagatatcttgtaacaagggcttagaaaatcttctttattttctatttctgacctcatcaaaccaacattttctatattccctagatagtaatcggataatgctttcacgttaagagctccatttatagagaataggtctttgtcgtcaaacattgcttttttagggtatatgtcttcaaatatgttgaaacctaactcctttctgaactttagctcccactcagcagggacatttaacaaacttgttagattgtggacatgattgtgcaatgatttaggcatcatataaatagccaaataaacattattgtacaaatcctcaagtgtcagtagagtcgatcctgttattggacattttatattcaagtttgttatacctcctataatatcgttttcgtggtctacgacaacaggcttggcatttgtgcttaaattgagatcttccattctgaacaatagttttttgattccattaacaaaatatatatctgccacattagttatatcaggatcgaatttatctctaatgtattcttttatattagaataatcagacagtggtaaaaaccctgcataccgcatgaaatcaaaaattcccatcctgctgagctttgtcacagttcctatcatgacagacgagaacacaatatttattaatatctgtttaacagtcattgtcatagaaaagacattcactttttctatatctttgtttttcagccatttttccatttcgttagctttttttgaaaattgtgcaaaacatacaggaactttactaggcgttttgaaaaggctcagcagcctcacctggttgagtctctgcggtctcattatataaatgtaattactaccacttcggaaatagctataaatttctttagtataacatatgttaaattgatccgacatatcttcatccactatgtgcaatgctatgtaaggaactcccgatcctccggtgttcattccatctcctttgaatgccagtagcatcatgctagtatttgctgtagttagtatcttgaaactttctttagtcatatacctgtctgccaccatcaaacctttggagaattgcatcatgtcttcagagtaatggtaaatggctaggtcattgcataatttgtttatctttttacaagtctccagttcagctttcagtactgaatcttgaatgtacaagcattcaggatttttagcataattattgtaaacagatgtgatcttgccttcctctcttatatcaccattatgaagaacaaacaaagaatccttaattctttcacaccagcttaagctgtcctcattgtcatgcctaattagttttttcctatgagtcagagaagacatgtctatacttgaataatcatcatttgggtcagcctgcctttctgaggtatcatattccaggcctttagaaatcctttcttttatttcttctttttttagaattcttttcttagagctcattcctatattcattactgctaaacctttaaaataggtagtcttgttctccttgcctgtctctctcatgcaaaattcatttttgttcctggtcaaacatgaaccctgcttactccattctttagatttctttgttctctcaactttgatgctcccagtgtttatatctatttcatcctcaagttcctgtttttccatttttgttgtatcacaacttagctctgttaaacacagtctaaccaagtttgttatatctcttgctttgttcgtttggttatttatgctactatatgggttattgtaaataattcttgaagaacttttgaagctttcccgaaatttgtttatgattgcattattgtaatctacttctgagctcaattcaattttttcaaaacttggggaccaagtcatggaaaagttagttttagtttcagaaagatcgtttgtaaaacagttaggatacttttcttcatattctgtggcattctggttaaaagctgtagttatgtcaggtatttctttctcctttttctttttttctctaattctaagcatgatcttctcaaggtgtttcccgtacaaagattcccatatttgctgtttttggattaagtggtctttcaaatcagctagatcagcttttggctctatttttaaattaatgcaagagttttggtaccctttaaatttgtcagcaatatgctggtcattcatcgtttcaatgtggaaacagaaattcccaaacaaaaaatgtattatttcttccctagggatttcttctgtaacaagtgagttaattattctttcaatatcttcagaataggctatttcagtaggatttctctctttgtatttgctggtccagtgactaaaaaacacatctttggatccaaaatcatcacctaagatccctctgacttcagatttgattttctgagtgtttgcgtaatagtttctcaccactgtgggtgtggttcctacgatttgtccaacataagaaatatttagcagtttggcatttctagcatgctttactctttctccatgcaatgctgatggagagtcttcaaattttcccaaaaccctgctgctagtaacagtgattggcatcccagcaataggtttcaatataacaatagaaacgaaaacagggtgatcttctaggaatggctttccattcacttttatatctttgaaagatttccagatatttttgtagtatttttccattgttttggtttcagttctggcatcaacagatattttccaatcataaatgattaaacaaagttcactgttttttgattctttatatattacatagttatcaggggtggcgttagttgctacatattctttgtttattctctcaaactcatcatcagagagcttgttaacacaggactttttgttgagctcatccagatattccctgagtgcatgctctatctccacctcgcttctttgtttgggttttattctcaggtgcctggagatcagctctccgaaaatatcatgccttgctaactctgtttctaggtatttttgctcaaacagagagaccatctcacctagcttcttgacatccacagttgccatccctttgtttagcccttctccatcggcagtgattttgacgattaattctctcatcgtctcatagttttttgcattattattaataatcacatcttctggaatctcatcactatttctcttatgtaaatccaaagccagatcatggttagaacctacacaatcctcaatagataacaataaagtggttccattttctattaatttctgtattttctggatgttcatgtttgcttaaaatcgttgttacctgattgctct

SEQ ID NO: 274 - DNA, 8640 bp, Tomato spotted wilt virus
atgaacatccagaaaatacaaaaattaatagaaaatggaaccactttactgttgtctattgaggattgtgtaggttctaaccacgatctagctttggatttacataagagaaatagtgatgagatcccagaagatgtgattataaataataatgcaaaaaattatgagacaatgagagagttaattgttaaaatcactgctgatggtgaagggctaaacaaagggatggcaactgtggatgtcaaaaagctaagtgagatggtctctctgtttgagcaaaaatacctagaaacagagttagcaaggcatgacatttttggagagctgatatccaggcacctgagaataaagcccaaacaaagaagtgaagtggagatagagcatgcactaagagaatatctggatgaactcaacaaaaagtcctgcattaataagctctctgacgatgagtttgagagaataaataaagaatatgtagcaactaatgccacccctgataactatgtgatatacaaagaatcaaaaaatagtgagctttgcttaatcatttatgattggaaaatatctgtcgatgccaggactgaaaccaaaacgatggaaaaatactacaaaaatatctggaaatctttcaaagatataaaagtgaatggaaagccattcctggaagatcatcctgttttcgtttctatagttatattgaaacctattgctgggatgccaatcactgttactagcagcagggttttggagaaatttgaagattctccatcagcattgcatggagaaagaataaagcatgctaaaaatgccaaattgctaaatatttcttatgttgggaaaatagttggaaccacacccacagtggtgagaaactattatgcaaacactcaaaaaatcaaaaatgaagtcggaggaatcttaggtgatgattttggatctaaagatgtattttttagtcactggaccagcaagtacaaagagagaaatcctactgaaatagcctattctgaagatattgaaagaataattgattcacttgtcacagatgaaatccctaaagaggaaataatacattttttgtttggaaatttctgtttccatattgaaacaatgaatgaccagcatattgctgacaaatttaaagggtaccaaaactcttgtatcaatttaaaaatagagccaaaaactgatttagctgatttgaaagaccacttaatccaaaaacagcaaatatgggattccttgtatgggaaacaccttgagaagattatgcttagaattagagaaaaaaagaaaaaagaaaaagaaatacctgacataaccactgcttttaaccagaatgctgctgaatatgaagaaaagtaccctaactgttttacaaatgatctttctgaaaccaaaaataacttttccatgacttggtccccaagttttgaaaaagttgaattgagctcagaggtagattacaacaacgcaattataaacaagtttcgggaaagcttcaaaagttcatcaaggattgtttataatagcccatatagtagcataaataaccaaacaaataaagcaagagatataacaaacttggttagactgtgcttaacagagctaagctgtgatacaacaaaaatggaaaagcaggagcttgaggatgaaatggatataaacactggaagtgttaaagttgagagaacaaaaaaatctaaagaatggaataagcagggttcgtgtttaaccaggaacaaaaacgaattttgcatgaaagagacaggcagggagaacaaaactacctatttcaaaggcttagcagtaatgaatataggaatgagttctaagaaaagaattctaaaaaaagaagaaataaaagaaaggatttctaaaggcctggaatatgacacctctgaaaggcaggctgacccaaatgatgattattcaagtatagacatgtcttctctgactcatatgaaaaaactaatcaggcacgataatgaggacagtttgagctggtgtgaaagaatcaaggattctttgtttgtccttcataatggtgatataagagaggaaggcaagatcacatctgtttacaataattatgctaaaaatcctgaatgcttgtacattcaagattcagtactgaaggctgaattagagacttgcaaaaagataaacaaattatgcaatgacttagccatttaccattactctgaagacatgatgcaattctccaaaggtttaatggtggctgacaggtatatgactaaagaaagtttcaagatactaacaacggcaaatacaagcatgatgctattggcattcaaaggagatggaatgaacactggtggatcaggagtaccttacatagcattgcatatagtggatgaagacatgtcaggtcaatttaacatatgttatactaaagaaatttatagctatttccgaagtggtagtaattacatttatataatgagaccacagagactcaaccaggtgaggctgctgagccttttcaaaacgcctagtaaagttcctgtgtgttttgcacaattttcaaagaaagctagtgaaatggaaaaatggctgaaaaacaaagatatagaaaaggtaaatgtcttttctatgacaatgactgtaaaacagatattaataaatattgtgttttcatctgtcatgataggaactgtgacaaagctcagcaggatgggaatttttgatttcatgcgatatgcagggtttttgccactgtccgattattctaatataaaagaatacattagagacaaatttgatcctgatataactaatgtggcagatatctattttgttaatggaatcaaaaaactactgttcagaatggaagatctcaatttaagcacaaatgccaagcctgttgttgtggaccacgaaaatgatattataggagggataacagacctgaatataaaatgcccaataacaggatcaactctgctgacacttgaagatctgtacaataatgtttatttggctatttatatgatgcctaaatcattgcacaatcatgttcacaatctaacaagcttgttaaatgtccctgctgagtgggaactaaagtttagaaaagagttaggtttcaacatatttgaagacatataccctaagaaagcgatgtttgatgacaaagacctgttctctataaatggagctttgaatgtgaaagcattatctgattactatctaggaaatacagaaaatgttggtttgatgagatcagaaatagaaaataaagaagatttcctgagcccttgttataaaatatctactttaaaatcttcaaaaaaatgctcacaatcaaacattataagtaccgatgaaataatagagtgtcttcagaatgcaaagatccaagatatagaaaattggaaaggaaataacctggccattataaaagggcttatgagaacctacaatgaggagaaagggcgattgatggaattttttgaggataattgtgtcaattcattatatcttgtagaaaagcttaaagagataattaatagtggatcaataactgtagggaaatctgtaacatctaaattcatacgaaataatcatcctttaacagtagaaacatatctcaaaacaaaactatattataagaataatgtgacagttttaaagtctaaaaaagtgtcagaggagctttatgaccttgtaaaacagtttcacaacatgatggagatagacctagattctgttatgaaccttgggaaaggcacagaagggaaaaaacacacattcttgcagatgcttgaatttgtcatgtccaaagctaaaaatgtcaccgggtctgtagatttcctagtttctgtttttgagaaaatgcagagaaccaaaacagacagagaaatatacttgatgagcatgaaagtgaaaatgatgctttattttatagagcacacattcaaacatgtggcacaaagtgatccatcggaagccatatctataagtggagacaataaaataagagcactttctacattatctttggacacaatcacgtcttacaatgatattttaaacaaaaattcaaagaagtcaagattggctttcctatctgctgatcagtcgaaatggtcggcatcagatcttacctataaatatgttttagctatcatattaaacccaattttaactactggtgaagctagtttaatgatagaatgcattttaatgtatgttaaattgaagaaagtttgcataccaacggatatttttttgaatctaaggaaagctcaaggaacttttgggcaaaatgaaactgccataggacttttgactaaagggttgacgacaaacacataccctgttagcatgaactggttgcaaggcaatttaaattatctgtcttctgtttatcactcttgtgcaatgaaagcttaccacaaaactttagaatgttacaaagactgtgatttccaaactagatggattgtgcactctgatgacaatgcaacatcattaatagccagtggaggggtcgataaaatgctaacagacttttcaagctcatctctgcctgaaatgttgtttagaagcattgaagctcatttcaaaagcttttgcataactttgaacccaaaaaagagttatgcctcttcatcagaagtagagttcatatctgaaagaatcgtgaacggagcgattattcctctctattgcaggcatttagcaaactgttgcacagaatcttcacatataagttattttgatgatctaatgtcactcagtatacatgttacaatgcttctgagaaaaggctgtcctaatgaagttataccttttgcttatggggctgtgcaggttcaagcattaagcatctattcaatgcttcctggtgaagtgaatgatagcatcagaatttttaacaagcttggagtaagtttaaaatcgaatgagattcctacaaacatggggggatggttgacttctcctatagagccgttgtctatattaggcccgtcatcaaatgatcaaatcatctattacaatgtgataagagattttttgaacaaaaaaagtttagatgaagttaaagatagtgtctcttcttccagctatctacagatgagattcagagagctaaaggaaaagtatgaaagaggaactctagaagaaaaggataaaaagatgatatttcttatcaatctgttcgagaaagcatcagtgtctgaagattcagacgttctaacaattgggatgaaattccaaaccatgttaactcagattataaaattacctaattttataaatgagaatgctttaaacaagatgtcaagttataaagatttttcaaaactttaccctaatttgaaaaagaatgaagatttatataaaagtactaagaacataaagatagacgaggatgctattttagaggaagatgaattatacgagaagattgcatctagcttagaaatggaatctgttcatgacataatgataaaaaatcccgaaactattttgatagcaccattgaatgatagagattttttacttagccagctgttcatgtacacaagcccttctaagaggaaccagttatcgaaccaatccacagagaaacttgctttagatagattgctaagatcaaaagctaaaacatttgtagacatttcttctactgtgaagatgacttatgaagaaaacatggaaaagaaaatcttagaaatgctaaaatttgatttagattcatattgttcatttaaaacatgtgtgaatctagtgatcaaggatgttaatttcagcatgctaattccaatattggattctgcatacccttgtgaatctaggaaaagagataactacaatttcaggtggttgcagactgagaaatggatacctgttgttgaaggctctccgggactagtagtgatgcatgctgtatatggatcaaattatatagaaaatttaggtctaaaaaacatccccctaacagacgatagcattaatgttttaacaagcacgtttggaacaggtttaatcatggaggatgtaaaatccctagttaatggcaaagacagcttcgaaacagaggctttcagcaattctaatgaatgtcaaagattggtgaaagcatgcaattatatgatagcagcacaaaacaggcttttagcaattaacacatgctttactaggaaaagcttccccttctattctaagtttaatctagggagagggtttatctcaaacacgttagctctcttatccaccatctacagtaaagaagaatcatatcattttgtttctacagctagttataaattagacaaaactatcagaactgtgataagtgctcagcaagatatgaacttagagaaaatactggacactgctgtatacatatcagataaattgcagtcacttttcccaacaattacaagagaagatatagttttgatattgcaaaatgtgtgccttgacagcaaacctatatggcagagtctagaagacaaaatgaaaaagattaacaattcgacagcaagtggcttcacagtctcaaatgtgattctatcacataacagtgaattgaacacaatccagaaacaaattgtttggatgtggaacatgggtttgtgttctcatagaacattagattttgttatcagatatattagaagaagtgatgtgagatatgtgaaaactgaagaacaagacgaatcgggaaattatgtctctggaactatgtacaaaatagggatcatgacaagaagctgctatgttcaattgatagcatctgatcaagatgtagcagtttctttgagaacaccgtttgagatattgaatgagagagagtatctttttgacacatacagagaaagtatagagaaattactgcagaaatttatgtttgataaagtgaacataataaaatcaaaacaaccacagattgttttcttagaaccaggagatgcctgcataagaatgaccacagacaacaaaatgattgtaaaggttaatgccacaccaaggcaaataagactagagaatgtaaaattaatcgtaaagataaaatatgaaaacgtgaactctgatgtgtgggatattattgaaagccaaaaatctctagttttgaggctccctgaagtaggggaatgtttctctgatatgtacaaaactgcagattctgaaactgaaacaataaaaaccataaaaaacaggctcatgacctctttaactttcatagaagcctttggaaacttatcacagcagatcaaagagattgtagatgatgatatcagagaagcgatggatgaattcttaatgaacatccgggatacctgcttagaaggtttggaaaactgcaaaagtgtggaggaatatgatagctatcttgatgaaaatggttttaatgacacagtagaactattcgaaaacttgctaagaacacatgacaactttgaaaatgagtatagtcctctgttttcagagattgttgacaaagcaaaacagtatactagagatttagaaggtttcaaagaaatactgcttatgcttaaatattctctgataaatgatgcatcaggatttaaaagctatagagccactggaacgcacgctgttgaactaatggcaaaaaagcacatagagataggggaattcaacttattgggaatgatccagttgattaaagcttgcgaaacatgccacaacaatgactctatattaaacttagcaagtttaaggaatgttcttagcaggacatatgccacatttgggaggagaataaaattggatcatgatctggacttgcaaaacaacttaatggaaaaaagttatgatttcaagacactggttttaccagaaattaaattatcagaactatctagggaaatactgaaagaaaatgggtttattatatctggggagaacctaaaaatagataggtctgatgaagaatttgagggtcttgctagctttaatgtgttgaggctagatgaggaagaaatgtatgaaggtttgatcaaagagatgaaaattaaaaggaaaaagagagggtttttatttccggcgaatacacttctgctaagtgagttgataaagttcttgattggtggaataaagggaaccagttttgatatagaaacattgttgcggaacagttttagaccagacatattttcaaccgacagattgggcagattaagttccagtgtacctgcactcaaagtttatgcaactgtttatatggaatataagaatgtcaattgccctttaaatgaaatagctgacagcttagaaggttatctaaaactgacaaaaagcaaatctaaggagcatttcttgtctggaagagttaagaaagccttgatacagttaagagatgaacaatcgcgaactaaaaaactagaggtctataaagatatcgcaaatttcctttctaggcacccgctatgtttatctgaaaaaacattatatggaagatacacctactatgacatcaatgattatatcatgcaaacaagagagattattttgagtaaaataagtgagttggatgaggttgttgaaacagatgaagacaatttcttgcttagttatctaagaggggaagaagatgcctttgatgaagatgagtttgatgaagaagaagacacagattaa

SEQ ID NO: 275 - DNA, 4821 bp, Tomato spotted wilt virus
agagcaatcagtgcatcagaaatatacctattatacattttgctaagaatcaatcaactacattacacaagctcctctaccttaggctgttgaactcgaaatgttgactcttttcggtaacaagaggccttctaagtctgtaatggcagtgttgaagtctcaaaaccatggtcttcttctgatgaaaagcttgctttaacccggaaaggatgaaggtcctttagtttcacttgctaaacacaaagccatggatgcatccaaaggaaagatactgttaaacattgagggaacatcttcctttggaacctatgaatctgattccatcacagagtcagaaggttatgatctttctgctagaatgatagtagatacaaaccatcatatctcaaactggaaaaatgatctttttgttggcaacggaaagcaaaatgctaataaggttatcaagatctgtccgacttgggacagcagaaaacaatacatgatgatttccagaattgtgatatgggtctgccccactataccaaaccctacaggaaaacttgtggttgctttaattgatcccaacatgccatctggaaagcaagtcatcctgaagggtcaggggacaataactgatcctatctgctttgttttttatctgaactggtctattccgaagatgaacaacaccccagaaaactgttgtcagctgcatttgatgtgtagccaagaatacaagaaaggggtttcttttggtagtgtcatgtattcttggacaaaagagtttggtgattcacccagagctgataaagacaaaagttgtatggttatacctctaaacagggccattagagctagatctcaggcattcattgaagcctgcaagctgataattcctaaaggaaacagtgagaagcagataaaaaaacagcttaaagaactgagctcaaatcttgagagatcagttgaagaggaagaggaaggaatttctgacagtgttgctcagttatcctttgatgaaatatagttctttaaatatcacttatttaagcttaaatttctgtctattttgcattttgaatccaaaaacccaaacaaaaaacgaaaacaaaaaagagaaaaaaacaaaaaatcaaaccaaaaaacaaaaacaaaataaggctgaaaagcaaactttggtccgaagactttttttgttgttttttgtttatttttatttttttgtttgttttttgtttattttatatttcgtttttattagttaatgattgattttaaagatttttctatatatataatcctgctaatatagaagattgaatcaaatttaatctgtgacaagcatcttcagacaaggtgagagaaatccataggtggccttcttcttgtcattgtatctttcattaacataggggctttgatctcaggttcatcatcatcctctatcttggatctagatttataagattcattctttacatatcctttacaaatggatgtcagaatagaacagaaataagtcacaagaaaaatgaatgcaataagcagtaccactctgatagtatcaaaaaatgagccaaagtaacttgcaatgaaattgaatggactcttaatataatcccagaagccccatgctgaagaatcagaattatattgttgttcttcatgagcatactcatcattttgatctattatattctctggttcttctacaataacattattaaccaaaacttccacagagatatccggattgccttctggatacaatgtcattttcttcttgtccggattggctgaacaaaacattgttatattgtatttattagatccttttttaacagctagctgataagtagataaagagcaagcatctatagaaattgcagtagaaaatgtcaaatctgagaaaaattctaaaaggcaagataaaccttggccgcatagaagacagccattgcaatttaagcttgttgaagttatggaaggtttcttaggagcaactttaaaaagatcagatggaagatcaactaccattttcagtttccctagactaaaagattttgccagaaaaaaactagaaaaatctttgaaactaacaggaatatctgatatttgctctaaaccagatctaaacctgtatgtgtcgtatccacatgttttgatagtgactgattttttccctattgctgcacaatcccaagacatgtcatctccttctagagttttcttagtaaaaataggcactccatcatgggtcaattgtggatgaccaaacattttcacaggatcattcaagtttgcaatatttccagagtaaatatgactgtcgggtccatgagctattagttcacctatagtgataccatcattatgcaaatctgcttgtatatcagcttgaaacaatgtattttcataaggaacctcttcagtaatccttgagcattgacctcccaaaataccggaaatacaaacatctgctactatagttgacttaagcactgaataaattctgtatgatttgtccatatcataaatatttcgacagaatccgcatgtagcaccctcattaattgcaaaacaccaagcttcttcacatccccaataagaagttggtgttacacaaaaatcttggaaacctgttaaagcttgatttttcctgcaagtgtcgcagtttcctgtacaagtggaataaaaatccgtgtgggtgctttggatgggagctgtcgtatatttttctgacacttcataatgaattcccacacttttgatataaatcacaaattttttggctgtttctgaggtcttgtcatttagcatgaatatagttcctcctcctcctaaaagagattgttctatcatatatctatatttcccgtctacaacagaatcaaagattaatgattgcctgggcagaatgttctctggtatgcttgtttcgtttttgtttaaggagtctccggcaaccattccagaaattttgccctgacggttataggaatctattataccatttctcaatctcttagcctcatacagaccaactgatgttaaccctaaagagcttcctgtataatccgaaaacccattgtacaaaggtttgtttcggaataaatctaggtattcgcaacctaatctgcattttataagattatcaatagatgggcgtgcaatgcaattctggttctctatgcaatcattaggaccttctataacaatattagtgccaaagatactctctatgatcttatcttcttttacattgcagtaacattgatctttttcagagcatttttcaaatttgcttgtaaccaaaaatggacagcctggaacataaaagcatccactcaaacattgggttgtttgagccatagacatgggcatctgagacaaaatgactaaacctatcaaaatttcggtcacaaattttagcaaactcaagctcagcttagtgttcactattagatggaaccattccatgctagtccacttatgtttgttgtagtcatgatctgcttctttggatagtatgggacactctgaagaatgctcttttgaagctttgcttttgttgcaaatgcagactttagtacactcatgtgtgactatgcacagattgccgcagttagaacattttaatgggaaatatttccataagcaatttatgagcaataagacagggtatgtaatcaagcccataagatcataccagagaaagagaggtttagtcgtcttgttcactaaccatcggatagggaaatagatcaacaaagctatcaatatcaaccttatccaagaaaaattgatgcaggctgtttgcttataaatactttttgaatatttgattatgcaatctctgactcttttgtttgtttttggtattttggctgatttgtcaccacacaagagattgtgttcaccatccaacatttcctcagtaaaagtgatacttgctgatccagaaaaagatataaccttgtgttccacattttcaccaggtttttttatcaaataacccatgatcttctcagggctagtgatgcttacagtatagggatttgcgaagtttgatttagttattttgcagtcaccggataactttacagtttgtaatgatactgttccattagtggggtatgagttgtaagttataggataattatcttgtgtcaggctttctgaaatgaagaattttcctcctactgaaaagtgtcttttcttgtctagcttggtaatgggaataaccgggactttggagaatctctttggcaaatttaaagaattatcacatttttctaaaccttctgctgaatcagaaacacaggaatatatgacaccattgttttcaacttgataataaacattataagtggatatcccttttatctcacattttaatgaagaagcattcaagcaattgttgggaagatccaaaacagagattgttttttgcgttgttggctcagcagaaatagggatggttgatttttcttctcgtatctgacgggttccaggagtccgagattctagcatcagattagttaaagtctctaagatagcttcgcgttgaatcgatgcagcagtgggtacctcattctcagcagaatcatcataaatctcaggatgatctccacgaattatttctactttagcatctgtggctctgaagatcaagaatgccaacaaaacagaactcagggcaattgtgaaaagactcacttttaccactagttctagtagttttagaattctcatcttagatgtctacccagattacaatggttgtgtgattaatttcaagatgtctggattaaggtttttgtttgcactgattgctct

SEQ ID NO: 276 - DNA, 4821 bp, Tomato spotted wilt virus; identical to SEQ ID NO: 275

SEQ ID NO: 277 - DNA, 4756 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaaaggatgaaggtcctttagtttcacttgctaaacataatggtaatgttgaagtctctaagccatggtcttcttctgatgaaaagcttgctttgactaaagctatggatacatccaaaggaaagatactgttgaacacagaaggaacatcttcctttggaacctatgagtctgattctatcacagaatcagagggttatgatctttctgcaagaatgatagtagatacaaaccatcatatctcaaactggaaaaatgatctctttgttggcaacgggaagcaaaacgcaaataaggtcatcaagatctgtccaacttgggacagcagaaaacaatacatgatgatttccaggattgtgatatgggtctgccccactataccaaaccctacaggaaaacttgtggttgctctggtcgatcccaacatgccatctgaaaagcaagtcattctgaagggtcaggggactataactgatcctatatgttttgtcttttatctgaactggtctattccgaaaatgaataacactccagaaaactgctgtcagctgcatttgatgtgcagccaagaatacaagaagggggtttcttttggtagtgtcatgtattcttggacaaaagagttttgtgattcacccagagctgataaagataaaagttgcatggtcatacctctaaacagagccattagagctagatctcaagcattcattgaggcttgcaagctgataattcctaaaggaaacagtgagaagcagattaaaaaacagcttaaagaattgagctcaaatcttgagagatcagttgaagaagaagaggaagggatttctgatagtgttgctcagttatcttttgatgaaatatagtacttttaatgtcacttatttaagcttaaatttctgtcaattttgcattttaaatcaaaaaccaaaacaaaaaacaaaaaatcaaaaacaaaaaacaaaaacaaaataaggctgaaaagccaaactttggtccgaagactctttttgttgttttttgttttttgtatttttttgtttgttttttgttcattttatatatacataatctgactaatgtagaagattgaatcaaatttagcctgtgacaagcagactcagacaaggtgagagaaatccataggtggccttcgtcttgtcattgtatctttcattaacataggagctttgatctcagaatcatcatcatcctctatcttggatctagatttataagattcattcttgacatatcctttacaaatggttgttagaatagaacagaaataaatcacaaggaaaatgaatgcaataagcaatatcactctgatagtatcaaaaaatgagccaaaataacttgcaatgaaattgaatgggcttttaatataatcccagaagccccatgctgaagaatcagaattatattgttgttcttcatgagcatactcatcattttgatctattatgttctctggttcttctacaataacattattgaccagaacttccacagaaatatccggattgccttctggatacaacgtcattttcttcttgtccggattagcagaacaaaacattgttatgttgtatttattagatccttttttaacagccagctgataagtagatagagagcaagcatctatagaaattgcagtagaaaatgtcaaatctgagaaaaattccaaaatgcaagataaaccttgaccgcatagaagacagccgttgcaatttaagcttgttgaagttatggaaggtctcttaggagcaactttaaaaagatcagatggaagatcaacgacaatcttaagtttccctaaactgaaagctttttccaagaaaaaactagagaaatctttgaaactaacgggaatatctgatatttgctctaaaccagatctaaatctgtatgtatcatatccgcatgttttaatagtgattgattttttccctattgctgcacaatcccaagacatgtcatctccttctagagttttcttagtaaaaataggcactccatcatgagtcaattgtgggtgaccaaacattttcacaggatcattcaagtttgcaatatttccagaataaatatggctgtcaggtccatgagctatcagttcacctatagtgataccatcattgtgcaaatctgcttgtatatcagcttgaaacaaggcattttcataaggaacctcttcagtaatctttgagcactgacctcctaaaataccagaaatacaaacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcttggaaaccagttaaagcttgattttttctgcaagtgtcacagtttcctgtacaagtggaataaaaatctgtgtgagtgctttggataggagctgttgtgtatttttctgacacttcataatgaattcctacacttttgatataaatcacaaatttttttgctgtttctgaggtcttatcatttaacatgaatatagtccctcctcctcctaaaagagattgttctatcatgtatctatatttcccgtctacaacagaatcaaagatcaatgattgtctgggcagaatgttctctggtatgcttgtttcatttttgtttagagaatctcctgcaatcattccggaaattttgtctgtacgattataagaatctattataccattcctcaatctcttagcctcatacagaccaaccgatgttaaccctaaagagcttcctgtataatctgaaaacccattatacaaaggtttgttccgaaataaatctaggtactcgcaacccagtctgcattttataagattatcaatcgatgggtgtgcagcacaattctggttctctatgcaatcattaggaccttctataacaatgttagtaccaaagatactttctataatcttatcttctttcacattacagtaacattgatctttttctgggcatttttcaaatttgcttgtaaccaaaaatggacagcctggaacataaaaacatccactcaagcattgggtagtttgagccatagacatgggcatttgagacaaaatgatcaaacctattaagatttcagtcacaaatttcagcaaactaaagctcagcttagtgttcactattagatggaaccattccatgctagtccacttgtgtttgttgtagccatgatctgtttctttggacaatatgggacactctgaagaatgttcttttgaagctttgcttttgttgcagatgcaaattttagtacattcatgtgtgattatgcacaaattgccacagttagaacatttaaatggaaaatatttccataagcaatttatgagcaacaaaatagggtatgtgatcaagcctataagatcataccagagaaagaggggtttggttgtcttgtttaccaaccaccggatagggaaatagatcaacaaagctatcaatattaatcttatccaagaaaaattgatgccagctgtttgtttataaatgctttttgaatatttgattatacaatctctaactcttttgtttgtttttggtattttagctgatttgtcaccgcacaggagattgtgctcaccatccaacatttcttcagtaaaagtgatgcttgctgatccagaaaaggatatgaccttgtgttccacattttcaccaggcttttttatcaaataacccatgatcttctcggggctagtgatgctaacagtatagggattggcaaagttcgatttagttattttgcagtcaccagataactttacagtttgtaatgatactgttccattagtggggtacgagttataagttataggataattatcttgtgtcaagctttctgaaatgaagaattttgttccaactgaaaaatgccttttgttgtcaagtttggtaatgggaataacagggactttggagaatctctttggcagatttaaagaattgtcacatttttctaaaccttccgctgaatcagaaacacaggaatatatgacaccattattttccacttgataataaacattataagtggataccccttttatctcacattttaatgaagaagcattcaagcagttattaggaagatctgagacagagattgttttttgcgtattcgactcagcaaaaatagggatgattgattctccttctcgtatctgacgggttccaggagtctgagattctagcatcagattagttaaagtctccaagatagccttgcgttgaatcgatgcagcagtgggtacttcattctcagcagaatcatcataaacctcaggatggtctccacgaattatttctactttggcatctgtggctctgaagatcaagaatgccaacaagacagaactcagggcaattgtgaaaagactcacttttaccactagttctagtagttttaaaattctcatcttagacgtctgctcagattataatggttatatgattaattgcaagatgtctggattaatggtttttgttggcactgattgctct

SEQ ID NO: 278 - DNA, 4768 bp, Tomato spotted wilt virus
agagcaatcagtgcatcagaaatatacctattatacactttgctaagaatcaatcaattacattacacaagctcctctaccttaggctgttgaactcaaaatgttgactcttttcggtaataaggggtcttctaagtctgccagaaaggatgaaggtcctttagtttcacttgctaaacataacggtaatgttgaagtctctaagccgtggtcttcttctgatgaaaagcttgctttgactaaagctatggatacatccaaaggaaagatactgttgaacacagaaggaacatcttcctttggaacctatgaatctgattctatcacagaatcagagggttatgatctttctgcaagaatgatagtagatacaaaccatcatatctcaaactggaaaaatgatctttttgttggcaacgggaagcaaaacgcaagtaaggtcatcaagatctgtccaacttgggacagcagaaagcaatacatgatgatttccaggattgtgatatgggtctgccccactataccaaaccctacagggaaactcgtggttgccctggtcgatcccaacatgccatctgaaaagcaagtcattctgaagggtcaggggacaatagctgatcctatatgttttgtcttttatctaaactggtctattccgaaaatgaataatactccagaaaactgctgtcagctgcatttgatgtgcagccaagaatacaagaagggggtttcttttggtagtgtcatgtattcttggacaaaggagttttgtgattcacccagagctgataaagataaaagttgcatggtcatacctctaaacagagctattagagctagatctcaggcattcattgaggcttgcaagctgataattcctaaaggaaacagtgagaagcagattaaaaaacagcttaaagaattgagctcaaatgttgtggggtccgttggagttggattgggggttttttttggtagtgttgctcagttatcttttgatgaaatatagtacttttaatgtcacttatttaagcttaaatttctgttaattttgcattttaaatcaaaaaccaaaacaaaaaacaaaagaaaaaacaaaaaatcaaaaacaaaaaacaaaaacaaaataaggctgaaaagccaaactttggtccgaagactctttttgttgttttttgtttatttgtattttttgtttgttttttgtttattttatatatacataatctgactaatgtagaagattgaatcaaatttagcctgtgacaagcagactcagacaaggtgagagaaatccataggtggccttcgccttgtcattgtatctttcatcaacataggggctttgatttcagaatcatcatcatcctctatcttggatctagatttataagattcattcttgacatatcctttacaaatggttgttagaatagaacagaaataaatcacaaggaaaatgaatgcaatgagcaatatcactctgatagtatcaaaaaatgagccaaaataacttgcaatgaaattgaatgggcttttaatataatcccagaagccccatgctgaagaatcagaattatattgttgttcttcatgagcatactcatcattttgatctattatgttctctggttcttctacaataacattattgaccagaacttccacaaaaatatccggattgccttctgggtacaacgtcattttcttcttgtctggattagcagaacaaaacattgttatgttgtatttattagatccttttttaacagccagctgataagtagatagagagcaagcatctatagaaattgcagtagaaaatgtcaagtctgagaaaaattctaaaatgcaagataaaccttgaccgcatagaagacagccgttgcaatttaagcttgttgaagttatggaaggtcttttaggagcaactttaaaaagatcagatggaagatcaacgacaatcttgagtttccctaaactaaaagctttttccaagaaaaaactagagaaatctttgaaactaacgggaatatctgatatttgctctaaaccagatctaaatctgtatgtgtcatatccgcatgttttaatagtgattgattttttccctattgctgcacaatcccaagacatgtcatctccttctagagttttcttagtaaaaataggcactccatcatgagtcaattgtgggtgaccaaacattttcacaggatcattcaagtttgcaatatttccagaataaatatggctgtcaggtccatgagctatcagttcacctatagtgataccatcattgtgcaaatctgcttgtatatcagcttgaaataaggcattttcataaggaacctcttcagtaatccctgagcactgacctcctaaaataccagaaatacaaacatctgccattatagttgattttagcactgaataaattctgtatgatttatccatgtcatagatattccgacagaatccgcatgtagcaccttcattaattgcaaaacaccaagcttcttcacatccccaataagaagttggtgttatacaaaaatcttggaaaccagttaaagcttgattttttctgcaagtatcacagtttcctgtacaagtggaataaaaatctgtgtgagtgctttggataggagctgttgtgtatttttctgacacttcataatgaattcccacacttttgatataaatcacaaatttttttgctgtttctgaggtcttatcatttaacatgaatatagtccctcctcctcctaaaagagattgttctatcatgtatctatatttcccgtctacaacagaatcaaagatcaatgattgtctaggcaaaatgttctctggtatgcttgtttcgtttttgtttagagaatctcctgcaatcattccagaaattttgtctgtacgattataagaatctattataccattcctcaatctcttagcctcatacagaccaaccgatgttaaccctaaagagcttcctgtataatctgaaaacccattatgcaaaggtttgttccgaaataagtctaggtactcgcaacccagtctgcattttataagattatcaatagatgggtgtgcagcacaattatgattctctatgcaatcattaggaccttctataacaatgttagtgccaaagatactttctataatcttatcttctttcacattacagtaacattgatctttttctgggcatttttcaaatttgcttgtaaccaaaaatggacagcctggaacataaaaacatccactcaaacattgggtagtttgagccatagacatgggcatttgagacaaaatgatcaaacctattaagatttcagtcacaaatttcagcaaactaaagctcagcttagtgttcactattagatggaaccattccatgctagtccacttgtgtttgttgtagccatgatctgtttctttggacagtatgggacactctgaagaatgttctttttgagctttgcttttgttgcagatgcaaattttagtacattcatgtgtgattatgcacaaattgccacagttagaacatttaaatggaaaatatttccataagcaatttatgagcaacaaaatagggtatgtgattaagcctataagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatacaatctctaactcttttgtttgtttttggtattttagctgatttgtcaccgcacaagagattgtgctcaccgtccagcatttcttcagtaaaagtgatgcttgctgatccagaaaaggatatgaccttatgttccacattttcaccaggcttttttatcaaataacccatgatcttctcggggctagtgatgctaacggtatagggattggcaaagttcgatttagttattttgcagtcaccagataactttacagtttgtaatgatactgttccattagtggggtacgagttataagttataggataattatcttgtgtcaagctttctgaaatgaagaattttgttccgactgaaaaatgccttttgttgtcaagtttggtaatgggaataacagggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcgttcaagcagttgttaggaagatctgagacagagattgttttttgcgtagttgactcagcaaaaatagggatggttgattcttcttctcgtatctgacgggttccaggagtctgagattctagcatcagattagttaaagtctccaagatagccttgcgttgaatcgatgcagcagtgggtacttcattctcagcagaatcatcataaacctcaggatggtctccacgaattatttctactttggcatctgtggctctgaagatcaagaatgccaacaagacagaactcagggcaattgtgaaaagactcacttttaccactagttctagtagttttaaaattctcatcttagacgtctgctcagattataatggttatatgattaattgcaagatgtctggattaatggtttttgtttgcactgattgctct

SEQ ID NO: 279 - DNA, 4829 bp, Tomato spotted wilt virus
agagcaatcagtgcatcagaaatatacctattatacactttgctaagaatcaatcaactacattacacaagctcctctaccttgggctgttgaactcaaaatgttgactcttttcggtaacaagaggccttctaagtctgccggaaaggatgaaggtcctttagtttcacttgctaaacataatggcaatgttgaagtctcaaaacaatggtcttcttctgatgaaaagcttgctttaaccaaagccatggatgcatccaaaggaaagatactgttgaacactaagggaacatcttcctttggaacctatgaatctgattctatcacagaatcagagggttatgatctttctgctagaatgatagtagatacaaaccatcatatctcaaactggaaaaatgatctttttgttggcaacggaaagcaaaatgctaataaggttatcaagatctgtccaacttgggacagcagaaaacaatacatgatgatttccaggattgtgatatgggtctgccccactataccaaaccctacagggaaacttgtggttgctttagttgatcccaacatgccatctgaaaagcaagtcatcctgaagggtcaagggacaataactgatcctatctgctttgttttttatctgaactggtctattccaaagatgaacaacaccccagaaaactgttgtcagctgcatttgatgtgcagccaagaatacaagaaaggggtttcttttggtagtgtcatgtattcttggacaaaagagttttgtgattcacccagagctgataaagacaaaagttgtatggttatacctctaaacagggccattagagctaggtctcaagcattcattgaagcctgcaagctgataattcctaaaggaaacagtgagaagcagattaaaaaacagcttaaagaattgagctcaaatcttgagagatcagttgaagaagaagaggaagggatttctgacagtgttgctcagttatcctttgatgaaatatagtttttttaaaaacacttatttaagcttaaatttctgtctattttgcatttcgaatccaaaaaaccgaaacaaaaaacaaaaaacaaaaaaagaaaaaacaaacaaaaaaaatcaaaccaaaaaacaaaaacaaaataaggctgaaaagccaaactttggtccgaagactctttttgttgttttttgtttatttgtattttttgtttgttgtttttgtttatttcatatttgctttttattagtcaatgattgattctaaagatttttatatatataaaatcctgttaatatagaagattgaatcaaatttaatctgtgacaagcatcctcagacaaggtgagagaaatccataggtggccttcgtcttgtcattgtatctttcattaacataggggctttgatctcaggttcatcatcatcctctatcttggatctagatttataagatttatgctttacatatcctttacaaatggatgtcagaatagaacagaaataaatcacaaggaaaatgaatgcaataagcagtaccactctgatagtatcaaaaaatgagccaaagtaacttgcaatgaaattgaatggacttttaatataatcccagaagccccatgcagaagaatcagaattatattgttgttcttcatgagcatactcatcattctgatctattatattctctggttcttctataataacattattaaccaaaacttccacaggtatatctggattgccttctggatacagtgtcatcttcttcttgtccgggttggctgaacaaaacattgttatattgtatttattagatccttttttaacagccagctgataagtagataaagagcaagcgtctatagaaattgcagtagaaaatgtcaaatctgagaaaaattctaaaatgcaagataaaccttggccgcatagaagacagccgttgcaatttaagcttgttgaagttatagaaggttttttaggaacaactttaaaaagatcagatggaagatcaactacgattttcagttcccctaaactaaaagatttttccaggaaaaaactagagaaatctttgaaactaacaggaatatctgatatttgctctaaaccagatctaaacctgtatgtgtcatatccacatgttttaatagtgactgattttttccctgttgctgcacaatcccaagacatgtcatctccttctagagttttcttagtaaaaataggcactccatcatgggtcaattgcggatgaccaaacattttcacaggatcattcaagtttgcaatatttccagagtaaatatggctgtcaggtccatgagctattagttcacctatagtgataccatcattatgcaaatctgactgtatatcagcttgaaacaatgtattttcataaggaacttcttcagtaatccttgagcattgtcctcccaaaataccagaaatacaaacatctgctactatagttgatttgagcactgaataaattctatatgatttgtcgatatcataaatatttcgacagaatccgcatgtagcaccctcattaattgcaaaacaccaagcttcttcacatccccagtaagaagttggtgttatacaaaaatcttggaaacctgttaaagcttgatttttcctgcaagtgtcgcagtttcctatacaagtgggataaaaatccgtatgggtgctttggatgggagctgttgtatattcttctgacacttcatgatgaattcccacacttttgatataaatcacaaattttttggctgtttctgaggtcttgtcatttagcatgaatatagttcctcctcctcccaaaagagattgttctatcatatatctatatttcccgtctacaacagaatcaaagattaatgattgcctgggcaggatgttctctggtatgcttgtttcatttttgtctaaagagtctcctgcaatcattccagaaattttgtctgtacgattataggaatctattataccatttctcaatctcttagcctcatacagaccaactgatgttaaccctaaagagctttctgtataatctgaaaacccattgtacaaaggtttgttctgaaataaatctaggtattcgcaacctaatctgcattttataagattatcaatagatgggcgtgcaatgcaattctggttctctatgcaatcattaggaccttctataacaatattagtgccaaagatactttctatgatcttgtcttcttttacattgcagtaacattgatctttttcagggcatttttcaaatttgcttgtaaccaaaaatggacagcctggaacataaaagcatccactcaaacattgggttgtttgagccatagacatgggaatctgagacaaaatgactaaacctatcaaaatttcggtcacaaattttagcaaactcaagctcagcttagtgttcactattagatggaaccattccatgctagtccacttatgtttgttgtagtcatgatctgcctctttggacaatatgggacactctgaagaatgctcttttgaagctttgcttttgttgcaaatgcagactttagtacactcacgtgtgactatgcacaaattgccgcagttagaacatttaaatgggaaatatttccataagcaatttatgagcaataagacagggtatgtgatcaagcccataagatcataccagagaaagagaggtttagtcgtcttgttcactaaccatcggatagggaaatagatcaacaaagctatcaatatcaatcttatccaagaaaaattgatgcaggctgtttgcttgtaaatactttttgaatatttgattatgcaatctctgactcttttgtttgtttttggtattttagctgatttgtcaccgcacaagagattgtgttcaccatccaacatttcctcggtaaaagtgatacttgctgatccagaaaaagctataaccttgtgttccacattttcaccaggtttttttatcaaataacccatgatcttctcagggctagtgatgctcacagtatagggatttgcaaagtttgatttagttattttgcagtcaccagataactttacagtttgtaatgatactgttccattagtggggtatgagttgtaagttataggataattatcttgtgtcaggctctctggaatgaagaaatttgttcctactgaaaaatgtcttttgttgtcaagtttggtaataggaataactgggactttggagaatctctttggcaaatttaaagaattatcacatttttctaaaccttctgctgaatcagaaacactggaatatatgacaccattgttttcaacttgataataaacattataagtagatatcccttttatctcacatttcaatgaggaagcattcaagcagttgttgggaagatccaaaacagagattgttttttgcgttgctggctcagtggaaatagggatggttaatttttcttctcgtatctgacgggttccaggagtccgagattctagcaccagattagttaaagtctccaagatagcttcgcgttgaatcgatgcagcagtgggtacctcattctcagcagaatcatcataaatctcaggatgatctccacgaattatttctactttagcatctgtggctctgaaggtcaagaatgccaacaaaacagaactcagggcaattgtgaaaagactcacttttaccactagttctagtagttttagaattctcatcttagatgtctacccagattacaatggttgtgtgattaatttcaagatgtctggattaaggtttttgtttgcactgattgctct

SEQ ID NO: 280 - DNA, 4769 bp, Tomato spotted wilt virus
agagcaatcagtgcatcagaaatatacctattatacattttgctaagaataaatcaattacattacacaagctcctctaccttaggctgttgaactcaaaatgttgactcttttcggtaataaagggtcttctaagtctgccagaaaggatgaaggtcctttagtttcacttgctaaacataatggtaatgttgaagtctctaagccatggtcttcttctgatgaaaagcttgctttgactaaagcaatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaacgggaagcaaaacgcaaataaggtcatcaagatctatccaacttgggacagcagaaaacaatacatgatgatttccaggattgtgatatgggtctgccccactataccaaaccctacagggaaacttgtggttgccctggttgatcccaacatgccatctgaaaagcaagtcattctgaagggtcaggggacaataactgatcctatatgttttgtcttttatctgaactggtctattccgaaaatgaataacactccagaaaactgctgtcagctgcatttgatgtgcagccaagagtacaagaagggggtttcttttggtagtgtcatgtattcctggacaaaggagttttgtgattcacccagagctgataaagataaaagttgcatggtcatacctctaaacagagctattagagctagatctcaagcattcatcgaggcttgcaagctgataattcctaaagggaacagtgagaagcagattaaaaaacagcttaaagaattaagctctaatcttgagagatcagttgaagaagaagaggaagggatttctgatagtgttgctcagttatcttttgatgaaatatagtacttttaatgtcacttatttaagcttaaatttctgttaattttgcattttaaatcaaaaaccaaaacaaaaaacaaaagaaaaaacaaaaaatcaaaaacaaaaaaacaaaaacaaataaggctgaaaagccaaactttggtccgaagactctttttgttgttttttgttcatttatatattttttgtttgttttttgtttattttatatatacataatctgactaatgcagaagattgaatcaaatttagcctgtgacaagcagactcagacaaggtgagagaaatccataggtggccttcgtcttgtcattgtatctttcattaacataggggctttgatctcagaatcatcatcatcctctatcttggatctagatttataagattcattcttgacatatcctttacaaatggttgttagaatagaacaaaaataaatcacaaggaaaatgaatgcaataagcaatatcactctgatagtatcaaaaaatgagccaaaataacttgcaatgaaattgaatgggcttttaatataatcccagaagccccatgctgaagaatcagaattatattgttgttcttcatgagcatactcatcattttgatctattatgttctctggttcttctacaataacattattgaccagaacttccacagaaatgtccggattgccttctggatacaacgtcattttcttcttgtcaggattagcagaacaaaacattgttatgttgtatttattagatccttttttaacagccagctgataagtagatagagagcaagcatctatagaaattgcagtagaaaatgtcaaatctgagaaaaattctaaaatgcaagataaaccttgaccgcatagaagacagccattgcaatttaagcttgttgaagttatggaaggtttcttaggagcaactttaaaaagatcagatggaagatcaacgacaattttgagtttccctaaactgaaagctttttccaagaaaaaactagagaaatctttgaaactaacgggaatatctgatatttgctctaaaccagatctaaatctgtatgtatcatatccgcatgttttaatagtgattgattttttccctattgctgcacaatcccaagacatgtcatctccttctagagttttcttagtaaaaataggcactccatcacgagtcaattgtgggtgaccaaacattttcacaggatcattcaagtttgcaatatttccagaataaatatggctgtcaggtccatgagctatcagttcacctatagtgataccatcattgtgcaaatctgcttgtatatcagcttgaaacaaggcattttcataaggaacctcttcagtaatccttgagcactgacctcctaaaatacctgaaatacaaacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcttggaaaccagttaaagcttgattttttctgcaagtgtcacagtttcctgtacaagtggaataaaaatctgtgtgagtgctttggataggagctgttgtgtatttttctgaaacttcataatgaattcccacacttttgatataaatcacgaatttttttgctgtttccgaggtcttatcatttaacatgaatatagtccctccccctcctaaaagagattgttctatcatgtatctatatttcccgtctacgacagaatcaaagatcaatgattgtctaggcagaatgttctctggtatgcttgtttcgtttttgtttagagaatctcctgcaatcattccagaaattttgtctgtacgattataagaatctattataccattcctcaatctcttagcctcatacagaccaatcgatgttaaccctaaagagcttcctgtataatctgaaaacccattatataaaggtttgttccgaaataaatctaggtactcgcaacccagtctgcattttataagattatcaatagatgggtttgcagcacaattctggttctctatgcaatcattaggaccttctataataatgttagtgccgaagatactttctataatcttatcttctttcacattacagtaacattgatctctttctgggcatttttcaaatttgcttgtaaccaaaaatggacagcctggaacataaaaacatccactcaaacattgggtagtttgagccatagacatgggcatttgagacaaaatgatcaaacctattaagatttcagtcacaaatttcagcaaactaaagctcagtttagtgttcactattagatggaaccattccatgctagtccacttgtgtttgttgtagccatgatctgtttctttggacaatatgggacactctaaagaatgttcttttgaagctttgcttttgttgcagatgcaaagtttagtacatttatgtgtgattatgcacaaattgccacggttagaacatttaaatgggaaatatttccataagcaatttatgagcaacaaaatagggtatgtgatcaagcctataagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaagagattgtgctcaccatccaacatttcttcagtaaaagtgatgcttgctgatccagaaaaggatatgaccttgtgttccacattttcaccaggcttttttatcaaataacccatgatcttctcggggctagtgatgctaacagtatagggattggcaaagttcgatttagttattttgcagtcaccagataactttacagtttgtaatgatactgtcccattagtaggatacgagttataagttataggataattatcttgtgtcagactttctgaaatgaagaattttgttccaactgaaaaatgccttttgttgtcaagtttggtaatgggaataaccgggactttggaaaatctctttggcagatttaaagaattgtcacatttttctaaaccttccgctgaatcagaaacacaggaatatatgacatcattattttccacttgataataaacattataagtggatatcccttttatctcacattttaatgaagaagcattcaagcagttgttagggagatccgagacagagattattttttgcgtagtcgactcagcaaaaatagggatggttgattcttcttctcgtatctgacgggttccaggagtctgagattctagcatcagattagtcaaagtctccaagatagccttgcgttgaatcgatgcagcagtgggtacttcattctcagcagaatcatcataaacctctggatggtctccacgaattatctctactttggcatctgtggctctgaagatcaagaatgccaacaagacagaactcagggcaattgtgaaaagactcacttttaccactagttctagtagttttaaaattctcatcttaaacgtctgctcggattataatggttatatgattaatttcaagatgtctggattaaggtttttgtttgcactgattgctct

SEQ ID NO: 281 - DNA, 4768 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaaaggatgaaggtcctttagtttcacttgctaaacataatggtaatgttgaagtctctaagccatggtcttcttctgatgaaaagcttgctttgactaaagctatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaacgggaagcaaaacgcaaataaggtcatcaagatctgtccaacttgggacagcagaaaacaatatatgatgatttccaggattgtgatatgggtctgccccactataccaaaccctacagggaaacttgtggttgccttggtcgatcccaacatgccatctgaaaagcaagtcattctgaagggtcaggggacaataactgatcctatatgttttgtcttttatctgaactggtctattccgaaaatgaataacactccagaaaactgctgtcagctgcatttgatgtgcagccaagaatacaagaagggggtttcttttggtagtgtcatgtattcttggacaaaggagttttgtgattcacccagagctgataaagataaaagttgcatggtcatacctctaaacagagctattagagctagatctcaagcattcattgaggcttgcaagctgataattcctaaaggaaacagtgagaagcagattaaaaaacagcttaaagaattgagctcaaatcttgagagatcagttgaagaagaagaggaagggatttctgatagtgttgctcagttatcttttgatgaaatatagtatttttaatgtcacttatttaagcttaaatttctgttaattttgcattttaaatcagaaaccaaaacaaaaaacaaaaaaagaaaaacaaaaaatcaaaaacaaaaaacaaaaacaaaataaggctgaaaagccaaattttggtccgaagactctttttgttgttttttgtttatttgtattttttgtttgttttttgtttatttatatatacataatctgactaatgtagaagattgaatcaaatttagcctgtgacaagcagactcagacaaggtgagagaaatccataggtggccttcgtcttgtcattgtatctttcattaacataggggctttgatctcggaatcatcatcatcctctatcttggatctagatttataagattcattcttgacatatcctttacaaatggttgttagaatagaacagaaataaatcacaaggaaaatgaatgcaataagcaataccactctgatagtatcaaaaaatgagccaaaataacttgcaatgaaattgaatgggcttttaatataatcccagaagccccatgctgaagaatcagaattatattgttgttcttcatgagcatactcatcattttgatctattatgttctctggttcttctacaataacattattgaccagaacttctacagaaatatccagattgccttctggatacaacgtcactttcttcttgtccggattagcagaacaaaacattgttatgttgtatttattagatccttttttaacagccagctgataagtagatagagagcaagcatctatagaaattgcagtagaaaatgtcaaatctgagaaaaattctaaaatgcaagataaaccttgaccacatagaagacagccgttgcaatttaagcttgttgaggttatggaaggcctcttaggagcaactttaaaaagatcagatggaagatcaacaacaatcttgagtttccctaaactgaaagctttttccaagaaaaaactagagaaatctttgaaactaacgggaatatctgatatttgttctaaaccagatctaaatctgtatgtatcatatccacatgttttaatagtgattgattttttccctattgctgcgcaatcccaagacatatcatctccttctagagttttcttagtaaaaataggcactccatcatgagtcaattgtgggtgaccaaacattttcacaggatcattcaagtttgcaatatttccagaataaatatggctgtcaggtccatgagctaccagttcacctatagtgataccatcattgtgcaaatctgcttgtatatcagcttgaaacaaggcattttcataaggaacctcttcagtaatccttgagcactgacctcccaagataccagaaatacaaacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcctggaaaccagttaaagcttgattttttctgcaagtgtcacagttccctgtacaagtagaataaaaatctgtgtgggtgctttggataggagctgttgtgtatttttctgacacttcataatgaattcccacacttttgatataaatcacaaatttttttgctgtttctgaggtcttatcatttaacatgaatatagtccctcctcctcctaaaagagattgttctatcatgtatctatatttcccgtctacaacagaatcaaagatcaatgattgtcgaggcagaatgttctctggtatgtttgtttcgtttttgtttagagaatctcctgcaatcattccagaaattttgtctgtacgattataagaatctattataccattcctcaatctcttagtctcatacagaccaaccgatgttaaccctaaagagcttcctgtataatctggaaacccattatacaaaggtttgttccgaaataaatctaggtactcgcaacccagtctgcattttataagattatcaatagatgggtgtgcagcacaattctggttctctatgcaatcattagggccttctataacaatgttagtgccaaagatactttctataatcttatcttctttcacattacagtaacattgatctttttctgggcatttttcaaatttgcttgtaaccaaaaatggacagcctggaacataaaaacatccactcaaacattgggtagtttgagccatagacatgggcatttgagacaaaatgatcaaacctattaagatttcagtcacaaatttcagcaaactaaagctcagcttagtgttcactattagatgaaaccattccatgctagtccacttgtgtttgtcatagccatgatctgtttctttggacaatatgggacactctgaagaatgttcttttgaagctttgcttttgttgcagatgcaaattttagtacattcatgtgtgattatgcacaaattgccacagttagaacatttaaatggaaaatatttccataagcaatttatgagcagcaaaacagggtatgtgatcaagcctataagatcataccagagaaagaggggtttggttgtcttgtttactaaccaccggatagggaaatagatcaacaaagctatcaatattaatcttatccaagaaaaattgatgcaggctgtttgtttgtaaatgctttttgaatatttgattatgcaatctctaactcttttgtttgtttttggtattttagctgatttgtcaccgcacaagagattgtgctcaccatccaacatttcttcagtaaaagtgatgcttgctgatccagaaaaggatatgaccttgtgttccacattttcaccaggcttttttatcaaataacccatgatcttctcggggctagtgatgctaacagtatagggattggcaaagtttgatttagttattttgcagtcaccagataactttacagtttgcaatgatactgttccattagtagggtacgagttataagttataggataattatcttgtgtcaggctttctgaaatgaagaattttgttccaactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccgagacagggattgttttctgtgtagttgactcagcaaaaatagggatggttgattcttcttctcgtatctgacgggttccaggagtctgagattctagcatcagattagtcaaagtctctaagatagctttgcgttgaatcgatgcagcagtggatacttcattctcagcagaatcatcataaacctcaggatggtctccacgaattatttctactttggcatctgtggctctgaagatcaagaatgccaacaagacagaactcagggcaattgtgaaaagactcacttttaccactagttctagtagttttaaaattctcatcttagacgtctgctcagattataatggttatatgattaatttcaagatgtctggattaaggtttttgtttgcactgattgctct

SEQ ID NO: 282 - DNA, 4767 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaagggatgaaggtcctttagtttcacttgctaaacataatggcaatgttgaagtctctaagccatggtcttcttctgatgaaaagcttgctttgactaaagctatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaacgggaagcaaaacgcaaataaggtcatcaagatctgtccaacttgggacagcaggaaacaatacatgatgatttccaggattgtgatatgggtctgccccactataccaaaccctacagggaaacttgtggttgccctggtcgatcccaacatgccatctgaaaagcaagtcattctgaagggtcaggggacaataactgatcctatatgttttgttttttatctgaactggtctattccaaaaatgaataacactccagaaaactgctgtcagctgcatttgatgtgcagccaagaatacaagaagggggtttcttttggtagtgtcatgtattcttggacaaaggagttttgtgattcacccagagctgataaagataaaagttgcatggtcatacctctaaacagagccattagagctagatctcaagcattcattgaggcttgcaagctgataattcctaaaggaaacagtgagaagcagattaaaaaacagcttaaagaattaagctcaaatcttgagagatcagttgaagaagaagaggaagggatttctgatagtgttgctcagttatcttttgatgaaatatagtattttactgtcacttatttaagcttaaatttctgttaattttgcattttaaatcaaaaaccaaaacaaaaaacaaaaaaagaaaaacaaaaaatcaaaaacaaaaaacaaaaacaaaataaggctgaaaagccaaactatggtccgaagactctttttgttgttttttgtttatttgtattttttgttgtttttttgtttatttatatatacataatctgactaatgtagaagattgaatcaaatttagcctgtgacaagcagactcagacaaggtgagagaaatccataggtggccttcgtcttgtcattgtatctttcattaacataggggctttgatctcagaatcatcatcatcctctatcttggatctagatttataagattcattcttgacatatcctttacaaatggttgttagaatagaacagaaataaatcacaaggaaaatgaatgcaataagcaataccactctgatagtatcaaaaaatgagccaaaataacttgcaatgaaattgaatgggcttttgatataatcccagaagccccatgctgaagaatcagaattatattgttgttcttcatgagcatactcatcattttgatctattatgttctctggttcttctacaataacattattgaccagaacttctacagaaatatccggattgccttctggatacaacgtcattttcttcttgtccggattagcagaacaaaacattgttatgttgtatttattagatccttttttaacagccagctgataagtagatagagagcaagcatctatagaaattgcagtagaaaatgtcagatctgagaaaaattctaaaatgcaagataaaccttgaccgcatacaagacagcctttgcaatttaagcttgttgaggttatggaaggtctcttaggagcaactttaaaaagatcagatggaagatcgatgacaatcttgagtttccctaaactgaaagctttttccaagaaaaaactagagaaatctttgaaactaacaggaatatctgatatttgttctaaaccagatctaaatctgtatgtatcatatccacatgttttaatagtgattgattttttccctattgctgcacaatcccaagacatatcgtctccttctagagtttttttagtaaaaataggcactccatcatgagtcaattgtgggtgaccaaacattttcacaggatcattcaagtttgcaatatttccagaataaatatggctgtcaggtccatgagctatcagttcacctatagtgataccgtcattgtgcaaatctgcttgtatatcagcttgaaacaaggcattttcataaggaacctcttctgtaatccttgagcactgacctcccaaaataccagaaatacagacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcctggaaaccagttaaagcttgattttttctgcaagtgtcacagtttcctgtgcaagtggaataaaaatctgtgtgggtgctttggataggagctgttgtgtatttttctgacactccataatgaattcccacacttttgatataaatcacaaatttttttgctgtttctgaggtcttatcatttaacatgaatatagtccctcctcctcctaaaagagattgttctatcatgtatctatatttcccgtctacaacagaatcaaagatcaatgattgtctaggcagaatgttctctggtatgcttgtttcgtttttgtttagagaatctcctgcaatcattccagaaattttgtctgtacgattataagaatctattataccattcctcaatctcttagcctcatacagaccaaccgatgttaaccctaaagagcttcctgtataatctgaaaacccattatacaaaggtttgttccgaaataaatctaggtactcgcaacccagtctgcattttataagattatcaatagatgggtttgcagcacaattctggttctctatgcaatcattaggtccttctataacaatgttagtgccaaagatactttctataatcttatcttctttcacattacagtaacattgatctttttctgggcatttttcaaatttgcttgtaaccaaaaacggacagcctgggacataaaaacatccactcaaacattgggtagtttgagccatagacatgggcatttgagacaaaatgatcaaacctattaagatttcagtcacaaatttcagcaaactaaagctcagcttagtgttcactattagatggaaccattccatgctagtccacttgtgtttgtcgtagccgtgatctgtttctttggacaatatgggacactctgaagaatgttcttttgaagctttgcttttgttgcagatgcaaattttagtacattcatgtgtgattatgcacaaattgccacagttagaacatttaaatggaaaatatttccataagcaatttatgagcagcaaaatagggtatgtgatcaagcctataagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaagagattgtgctcaccatccaacatttcttcagtaaaagtgatgcttgctgatccagaaaaggatatgaccttgtgttccacattttcaccaggcttttttatcaaataacccatgatcttctcggggctagtgatgctaacagtatagggattggcaaagtttgatttagttattttgcagtcaccagataactttacagtttgcaatgatactgttccattagtagggtacgagttataagttataggataattatcttgtgtcaggctttctgaaatgaagaattttgttccaactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccgagacagagattgttttttgtgtagttgactcagcaaaaatagggatagttgattcttcttctcgtatctgacgggttctgggagtctgagattctagcatcagatcagtcaaagtctctaagatagccttgcgttgaatcgatgcagcagttggtacttcattctcagcagaatcatcgtaaacctcaggatggtctccacgaattatttctactttagcatctgtggctctgaagatcaagaatgccagcaagacagaactcagggcaattgtgaaaagactcacttttaccactagttctagtagttttaaaattctcatcttagacgtctgctcagattataatggttatatgattaatttcaagatgtctggattaaggtttttgtttgcactgattgctct

SEQ ID NO: 283 - DNA, 4767 bp, Tomato spotted wilt virus
agagcaatcagtgcatcagaaatatacctattatacactttgctaagaatcaatcaattacattacacaagctcctctaccttaggctgttgaactcaaaatgttgactcttttcggtaataaggggtcttctaagtctgccagaagggatgaaggtcctttagtttcacttgctaaacataatggcaatgttgaagtctctaagccgtggtcttcttctgatgaaaagcttgctttgactaaagctatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaacgggaagcaaaccgcaaataaggtcatcaagatctgtccaacttgggacagcaggaaacaatacatgatgatttccaggattgtgatatgggtctgccccactataccaaaccctacagggaaacttgtggttgccctggtcgatcccaacatgccatctgaaaagcaagtcattctgaagggtcaggggacaataactgatcctatatgttttgttttttatctgaactggtctattccgaaaatgaataacactccagaaaactgctgtcagctgcatttgatgtgcagccaagaatacaagaagggggtttcttttggtagtgtcatgtattcttggacaaaggagttttgtgattcacccagagctgataaagataaaagttgcatggtcatacctctaaacagagctattagagctagatctcaagcattcattgaggcttgcaagctgataattcctaaaggaaacagtgagaagcagattaaaaaacagcttaaagaattaagctcaaatcttgagagatcagttgaagaagaagaggaagggatttctgatagtgttgctcagttatcttttgatgaaatatagtattttactgtcacttatttaagcttaaatttctgttaattttgcattttaaatcaaaaaccaaaacaaaaaacaaaaaaaagaaaaacaaaaatcaaaaacaaaaaacaaaaacaaaataaggctgaaaagccaaactatggtccgaagactctttttgttgttttttgtttatttgtattttttgtttgttttttgtttatttatatatacataatctgactaatgtagaagattgaatcaaatttagcctgtgacaagcagactcagacaaggtgagagaaatccataggtggccttcgtcttgtcattgtatctttcattaacataggggctttgatctcagaatcatcatcatcctctatcttggatctagatttataagattcattcttgacatatcctttacaaatggttgttagaatagaacagaaataaatcacaaggaaaatgaatgcaataagcaataccactctgatagtatcaaaaaatgagccaaaataacttgcaatgaaattgaatgggcttttgatataatcccagaagccccatgctgaagaatcagaattatattgttgttcttcatgagcatactcatcattttgatctattatgttctctggttcttctacaataacattattgaccagaacttctacagaaatatccggattgccttctggatacaacgtcattttcttcttgtccggattagcagaacaaaacattgttatgttgtatttattagatccttttttaacagccagctgataagtagatagagagcaagcatctatagaaattgcagtagaaaatgtcagatctgagaaaaattctaaaatgcaagataaaccttgaccgcatagaagacagccgttgcaatttaagcttgttgaggttatggaaggtctcttaggagcaactttaaaaagatcagatggaagatcgacaacaatcttgagtttccctaaactgaaagctttttccaagaaaaaactagagaaatctttgaaactaacaggaatatctgatatttgttctaaaccagatctaaatctgtatgtatcatatccacatgttttaatagtgattgattttttccctattgctgcacaatcccaagacatatcgtctccttctagagtttttttagtaaaaataggcactccatcatgagtcaattgtgggtgaccaaacattttcacaggatcattcaagtttgcaatatttccagaataaatatggctgtcaggtccatgagctatcagttcacctatagtgataccgtcattgtgcaaatctgcttgtatatcagcttgaaacaaggcattttcataaggaacctcttctgtaatccttgagcactgacctcccaaaataccagaaatacagacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcctggaaaccagttaaagcttgattttttctgcaagtgtcacagtttcctgtgcaagtggaataaaaatctgtatgggtgctttggataggagctgttgtgtatttttctgacacttcataatgaattcccacacttttgatataaatcacaaatttttttgctgtttctgaggtcttatcatttaacatgaatatagtccctcctcctcctaaaagagattgttctatcatgtatctatatttcccgtctacaacagaatcaaagatcaatgattgtctaggcagaatgttctctggtatgcttgtttcgtttttgtttagagaatctcctgcaatcattccagaaattttgtctgtacgattataagaatctattataccattcctcaatctcttagcctcatacagaccaaccgatgttaaccctaaagagcttcctgtataatctgaaaacccattatacaaaggtttgttccggaataaatctaggtactcgcaacccagtctgcattttataaggttatcaatagatgggtttgcagcacaattctggttctctatgcaatcattaggtccttctataacaatgttagtgccaaagatactttctacaatcttatcttctttcacattacagtaacattgatcttcttctgggcatttttcaaatttgcttgtaaccaaaaacggacagcctgggacataaaaacatccactcaaacattgggtagtttgagccatagacatgggcatttgagacaaaatgatcaaacctattaagatttcagtcacaaatttcagcaaactaaagctcagcttagtgttcactattagatggaaccattccatgctagtccacttgtgtttgtcgtagccgtgatctgtttctttggacaatatgggacactctgaagaatgttcttttgaagctttgcttttgttgcagatgcaaattttagtacattcatgtgtgattatgcacaaattgccacagttagaacatttaaatggaaaatatttccataagcaatttatgagcagcaaaatagggtatgtgatcaagcctataagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaagagattgtgctcaccatccaacatttcttcagtaaaagtgatgcttgctgatccagaaaaggatatgaccttgtgttccacattttcaccaggcttttttatcaaataacccatgatcttctcggggctagtgatgctaacagtatagggattggcaaagtttgatttagttattttgcagtcaccagataactttacagtttgcaatgatactgttccattagtagggtacgagttataagttataggataattatcttgtgtcaggctttctgaaatgaagaattttgttccaactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccgagacagagattgttttttgtgtagttgactcagcaaaaatagggatagttgattcttcttctcgtatctgacgggttccgggagtctgagattctagcatcagattagtcaaagtatccaagatagccttgcgttgaatcgatgcagcagttggtacttcattctcagcagaatcatcgtaaacctcaggatggtctccacgaattatttctactttagcatctgtggctctgaagatcaagaatgccagcaagacagaactcagggcaattgtgaaaagactcacttttaccactagttctagtagttttaaaattctcatcttagacgtctgctcagattataatggttatatgattaatttcaagatgtctggattaaggtttttgtttgcactgattgctct

SEQ ID NO: 284 - DNA, 4764 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaagggatgaaggtcctttagtttcacttgctaaacataatggcaatgttgaagtctctaagccatggtcttcttctgatgaaaagcttgctttgactaaagctatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaacgggaagcaaaccgcaaataaggtcatcaagatctgtccaacttgggacagcaggaaacaatacatgatgatttccaggattgtgatatgggtctgccccactataccaaaccctacagggaaacttgtggttgccctggtcgatcccaacatgccatctgaaaagcaagtcattctgaagggtcaggggacaataactgatcctatatgttttgttttttatctgaactggtctattccgaaaatgaataacactccagaaaactgctgtcagctgcatttgatgtgcagccaagaatacaagaagggggtttcttttggtagtgtcatgtattcttggacaaaggagttttgtgattcacccagagctgataaagataaaagttgcatggtcatacctctaaacagagctattagagctagatctcaagcattcattgaggcttgcaagctgataattcctaaaggaaacagtgagaagcagattaaaaaacagcttaaagaattaagctcaaatcttgagagatcagttgaagaagaagaggaagggatttctgatagtgttgctcagttatcttttgatgaaatatagtattttactgtcacttatttaagcttaaatttctgttaattttgcattttaaatcaaaaaccaaaacaaaaaacaaaaagaaaaacaaaaatcaaaaacaaaaaacaaaaacaaaataaggctgaaaagccaaactatggtccgaagactctttttgttgttttttgtttatttgtattttttgtttgttttttgtttatttatatatacataatctgactaatgtagaagattgaatcaaatttagcctgtgacaagcagactcagacaaggtgagagaaatccataggtggccttcgtcttgtcattgtatctttcattaacataggggctttgatctcagaatcatcatcatcctctatcttggatctagatttataagattcattcttgacatatcctttacaaatggttgttagaatagaacagaaataaatcacaaggaaaatgaatgcaataagcaataccactctgatagtatcaaaaaatgagccaaaataacttgcaatgaaattgaatgggcttttgatataatcccagaagccccatgctgaagaatcagaattatattgttgttcttcatgagcatactcatcattttgatctattatgttctctggttcttctacaataacattattgaccagaacttctacagaaatatccggattgccttctggatacaacgtcattttcttcttgtccggattagcagaacaaaacattgttatgttgtatttattagatccttttttaacagccagctgataagtagatagagagcaagcatctatagaaattgcagtagaaaatgtcagatctgagaaaaattctaaaatgcaagataaacctcgaccgcatacaagacagccgttgcaatttaagcttgttgaggttatggaaggtctcttaggagcaactttaaaaagatcagatggaagatcgacgacaatcttgagtttccctaaactgaaagctttttccaagaaaaaactagagaaatctttgaaactaacaggaatatctgatatttgttctaaaccagatctaaatctgtatgtatcatatccacatgttttaatagtgattgattttttccctattgctgcacaatcccaagacatatcgtctccttctagagtttttttagtaaaaataggcactccatcatgagtcaattgtgggtgaccaaacattttcacaggatcattcaagtttgcaatatttccagaataaatatggctgtcaggtccatgagctatcagttcacctatagtgataccgtcattgtgcaaatctgcttgtatatcagcttgaaacaaggcattttcataaggaacctcttctgtaatccttgagcactgacctcccaaaataccagaaatacagacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcctggaaaccagttaaagcttgattttttctgcaagtgtcacagtttcctgtgcaagtggaataaaaatctgtgtgggtgctttggataggagctgttgtgtatttttctgacacttcataatgaattcccacacttttgatataaatcacaaatttttttgctgtttctgaggtcttatcatttaacatgaatatagtccctcctcctcctaaaagagattgttctatcatgtatctatatttcccgtctacaacagaatcaaagatcaatgattgtctaggcagaatgttctctggtatgcttgtttcgtttttgtttagagaatctcctgcaatcattccagaaattttgtctgtacgattataagaatctattataccattcctcaatctcttagcctcatacagaccaaccgatgttaaccctaaagagcttcctgtataatctgaaaacccattatacaaaggtttgttccggaataaatctaggtactcgcaacccagtctgcattttataagattatcaatagatgggtttgcagcacaattctggttctctatgcaatcattaggtccttctataacaatgttagtgccaaagatactttctataatcttatcttctttcacattacagtaacattgatcttcttctgggcatttttcaaatttgcttgtaaccaaaaacggacagcctgggacataaaaacatccactcaaacattgggtagtttgagccatagacatgggcatttgagacaaaatgatcaaacctattaagatttcagtcacaaatttcagcaaactaaagctcagcttagtgttcactattagatggaaccattccatgctagtccacttgtgtttgtcgtagccgtgatctgtttctttggacaatatgggacactctgaagaatgttcttttgaagctttgcttttgttgcagatgcaaattttagtacattcatgtgtgattatgcacaaattgccacagttagaacatttaaatggaaaatatttccataagcaatttatgagcagcaaaatagggtatgtgatcaagcctataagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaagagattgtgctcaccatccaacatttcttcagtaaaagtgatgcttgctgatccagaaaaggatatgaccttgtgttccacattttcaccaggcttttttatcaaataacccatgatcttctcgggactagtgatgctaacagtatagggattggcaaagtttgatttagttattttgcagtcaccagataactttacagtttgcaatgatactgttccattagtagggtacgagttataagttataggataattatcttgtgtcaggctttctgaaatgaagaattttgttccaactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccgagacagagattgttttttgtgtagttgactcagcaaaaatagggatagttgattcttcttctcgtatctgacgggttccgggagtctgagattctagcatcagattagtcaaagtatccaagatagccttgcgttgaatcgatgcagcagttggtacttcattctcagcagaatcatcgtaaacctcaggatggtctccacgaattatttctactttagcatctgtggctctgaagatcaagaatgccagcaagacagaactcagggcaattgtgaaaagactcacttttaccactagttctagtagtttcaaaattctcatcttagacgtctgctcagattataatggttatatgattaatttcaagatgtctggattaaggtttttgtttgcactgattgctct

SEQ ID NO: 285 - DNA, 4766 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaaaggatgaaggtcctttagtttcacttgctaaacataatggtaatgttgaagtctctaagccatggtcttcttctgatgaaaagcttgctttgactaaagctatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaacgggaagcaaaacgcaaataaggtcatcaagatctgtccaacttgggacagcagaaaacaatatatgatgatttccaggattgtgatatgggtctgccccactataccaaaccctacagggaaacttgtggttgccctggtcgatcccaacatgccatctgaaaagcaagtcattctgaagggtcaggggacaatagctgatcctatatgttttgtcttttatctgaactggtctattccgaaaatgaataacactccagaaaactgctgtcagctgcatttgatgtgcagccaagaatacaagaagggggtttcttttggtagtgtcatgtattcttggacaaaggagttttgtgattcacccagagctgataaagataaaagttgcatggtcatacctctaaacagagctattagagctagatctcaagcattcattgaggcttgcaagctgataattcctaaaggaaacagcgagaagcagattaaaaaacagcttaaagaattgagctcaaatcttgagagatcagttgaagaagaagaggaagggatttctgatagtgttgctcagttatcttttgacgaaatatagtatttttaatgtcacttatttaagcttaaatttctgttaattttgcattttaaatcagaaaccaaaacaaaaaacaaaaaagaaaacaaaaaatcaaaaacaaaaaacaaaaacaaaataaggctgaaaagccaaattttggtccgaagactctttttgttgttttttgtttatttgtattttttgtttgttttttgtttatttatatatacataatctgactaatgtagaagattgaatcaaatttagcctgtgacaagcagactcagacaaggtgagagaaatccataggtggccttcgtcttgtcattgtatctttcattaacataggggctttgatctcggaatcatcatcatcctccatcttggatctagatttataagattcattcttgacatatcctttacaaatggttgttagaatagaacagaaataaatcacaaggaaaatgaatgcaataagcaataccactctgatagtatcaaaaaatgagccaaaataacttgcaatgaaattgaatgggcttttaatataatcccagaagccccatgctgaagaatcagaattatattgttgttcttcatgagcatactcatcattttgatctattatgttctctggttcttctacaataacattattgaccagaacttctacagaaatatccggattgccttctggatacaacatcactttcttcttgtccggattagcagaacaaaacattgttatgttgtatttattagatccttttttaacagccagctgataagtagatagagagcaagcatctataaaaattgcagtagaaaatgtcaaatctgagaaaaattctaaaatgcaagataaaccttgaccgcatagaagacagccgttgcaatttaagcttgttgaggttatggaaggtctcttaggagcaactttaaaaagatcagatggaagatcaacgacaatcttgagtttccctaaactgaaagctttttccaagaaaaaactagagaaatctttgaaactaacaggaatatctgatatttgttctaaaccagatctaaatctgtatgtatcatatccacatgttttaatagtgattgattttttccctattgctgcacaatcccaagacatatcatttccttctagagttttcttagtaaaaataggcactccatcatgagtcaattgtgggtgaccaaacattttcacaggatcattcaagtttgcaatatttccagaataaatatggctgtcaggtccatgagctatcagttcacctatagtgataccatcattgtgcaaatctgcttgtatatcagcctgaaacaaggcattttcataaggaacctcttcagtaatccttgagcactgacctcccaaaataccagaaatacaaacatctgccactatagttgattttagcactgaataaattctgtatgatttatccatgtcatagatattccgacagaatccgcatgtagcaccttcattaattgcgaaacaccaagcttcttcacatccccaataagaagttggtgttatacaaaaatcctggaaaccagttaaagcttgattttttctgcaagtgtcacagtttcctgtacaagtagaataaaaatctgtgtgggtgctttggataggagctgttgtgtatttttctgacacttcataatgaattcccacacttttgatataaatcacaaatttttttgctgtttctgaggtcttatcatttaacatgaatatagtccctcctcctcctaaaagagattgttctatcatgtatctatatttcccgtctacaacagaatcaaagatcaatgattgtctaggcagaatgttctctggtatgcttgtttcgtttttgtttagagaatctcctgcaatcattccagaaattttgtctgtacgattataagaatctattataccattcctcaatctcttagtctcatacagaccaaccgatgttaaccctaaagagcttcctgtataatctggaaacccattatacaaaggtttgttccgaaataaatctaggtactcgcaacccagtctgcattttataagattatcaatagatgggtgtgcagcacaattctggttctctatgcaatcattagggccttctataacaatgttagtgccaaagatactttctataatcttatcttcttccacattacagtaacattgatctttttctgggcatttttcaaatttgcttgtaaccaaaaatggacagcctggaacataaaaacatccactcaaacattgggtagtttgagccatagacatgggcatttgagacaaaatgatcaaacctattaagatttcagtcacaaatttcagcaaactaaagctcagcttagtgttcactattagatggaaccactccatgctagtccacttgtgtttgtcatagccatgatctgtttctttggacaatatgggacactctgaagaatgttcttttgaagctttgcttttgttgcagatgcaaattttagtacattcatgtgtgattatgcacaaattgccacagttagaacatttaaatggaaaatatttccataagcaatttatgagcagcaaaacagggtatgtgatcaagcctataagatcataccagagaaagaggggtttggttgtcttgtttactaaccaccggataggaaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaagagattgtgctcaccatccaacatttcttcagtaaaagtgatgcttgctgatccagaaaaggatatgaccttgtgttccacattttcaccaggcttttttatcaaataacccatgatcttctcggggctagtgatgctaacagtatagggattggcaaagtttgatttagttattttgcagtcaccagataactttacagtttgcaatgacactgttccattagtagggtacgagttataagttataggataattatcttgtgtcaggctttctgaaatgaagaattttgttccaactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccgagacagggattgttttttgcgtagttgactcagcaaaaatagggatggttgattcttcttctcgtatctgacgggttccaggagtctgagattctagcatcagattagtcaaagtctccaagatagccttgcgttgaatcgatgcagcagtgggtacttcattctcagcagaatcatcataaacctcaggatggtctccacgaattatttctactttggcatctgtggctctgaagatcaagaatgccaacaagacagaactcagggcaattgtgaaaagactcacttttaccactagttctagtagttttaaaattttcatcttagacgtctgctcagattataatggttatatgattaatttcaagatgtctggattaaggtttttgtttgcactgattgctct

SEQ ID NO: 286 - DNA, 4827 bp, Tomato spotted wilt virus
agagcaatcagtgcgtcagaaatatacctattatacactttgctaagaatcaatcaactacattacacaagctcctctaccttaggctgttgaactcaaaatgttgactcttttcggtaacaagaggccttctaagtctgccggaaaggatgaaggtcctttagtttcacttgctaaacataatggcaatgttgaagtctcaaaaccatggtcttcttctgatgaaaagcttgctttaaccaaagccatggatgcatccaaagggaagatactgttgaacactgagggaacatcttcttttggaacctatgaatctgattctatcacagaatcagagggttatgatctttctgctagaatgatagtagatacaaaccatcatatctcaaactggaaaaatgatctttttgttggcaacggaaagcaaaatgctaataaggttatcaagatctgtccaacttgggacagcagaaaacaatacatgatgatttccaggattgtgatatgggtctgccccactataccaaaccctacagggaaacttgtggttgctttagttgatcccaacatgccatctgaaaagcaagtcatcctgaagggtcaagggacaataactgatcctatctgctttgttttttatctgaactggtctattccaaagatgaacaacaccccagaaaactgttgtcagctgcatttgatgtgcagccaagaatacaagaaaggggtttcttttggtagtgtcatgtattcttggacaaaagagttttgtgattcacccagagctgataaagacaaaagttgtatggttatacctctaaacagggccattagagctaggtctcaagcattcattgaagcctgcaagctgataattcctaaaggaaacagtgagaagcagattaaaaaacagcttaaagaattgagctcaaatcttgagagatcagttgaagaagaagaggaagggatttctggcagtgttgctcagttatcctttgatgaaatatagttttttaaaaacacttatttaagcttaaatttctgtctattttgcatttcgaatccaaaaaaccgaaacaaaaaacaaaaaaacaaaaagagaaaaacaaacaaaaaaatcaaaccaaaaaacaaaaacaaaataaggctgaaaagccaaactttggtccgaagactctttttgttgttttttgtttatttgtattttttgtttgttgtttttgtttatttcatatttgctttttattagtcaatgattgattctaaagatttttatatatataaaatcttgctaatatagaagatttaatcaaatttaatctgtgacaagcatcctcagacaaggtgagagaaatccataggtggccttcgtcttgtcattgtatctttcattaacataggggctttgatctcaggttcatcatcatcctctatcttggatctagatttataagatttatgctttacatatcctttacaaatggatgtcagaatagaacagaaataaatcacaaggaaaatgaatgcaataagcagtaccactctgatagcatcaaaaaatgagccaaagtaacttgcaatgaaattgaatggacttttaatataatcccagaagccccatgcagaagaatcagaattatattgttgttcttcatgagcatactcatcattttgatctattatattctctggttcttctataataacattattaaccaaaacttccacagatatatccagattgccttctggatacagtgtcattttcttcttgtccgggttggctgaacaaaacattgttatattgtatttattagatccttttttaacagccagctgataagtagataaagagcaagcgtctatagaaattgcagtagaaaatgtcaaatctgagaaaaattctaaaacgcaagataaaccttggccgcatagaagacagccgttgcaatttaagcttgttgaagttatggaaggttttttaggaacaactttaaaaagatcagatggaagatcaactacaattttcagtttccctaaactaaaagatttttccaggaaaaaactagagaaatctttgaaactaacaggaatatctgatatttgttctaaaccagatctaaacctgtatgtgtcatatccacatgttttaatagtgactgatttttttcctattgctgcacaatcccaagacatgtcatctccttctagagttttcttagtaaaaataggcactccatcatgggtcaattgcggatgaccaaacattttcacaggatcattcaagtttgcaatatttccagagtaaatatggctgtcaggtccatgagctattagttcacctatagtgataccatcattatgcaaatctgcctgtatatcagcttgaaacaatgtattttcataaggaacttcttcagtaatccttgagcattgacctcccaaaataccagaaatacaaacatctgctactatagttgatttgagaactgaataaattctatatgatttgtccatatcataaatatttcgacagaatccgcatgtagcaccctcattaattgcaaaacaccaagcttcttcacatccccaataagaagttggtgttatacaaaaatcttggaaacctgttaaagcttgatttttcctgcaagtgtcgcagtttcctgtacaagtggaataaaaatccgtatgggtgctttggatgggagctgttgtatatttttctgacacttcataatgaattcccacacttttgatataaatcacaaattttttggctgtttctgaggtcttgtcatttaacatgaatatagttcctcctcctcccaaaagagattgttctatcatatatctatatttcccgtctacaacagaatcaaagattaatgattgcctgggcaggatgttctctggtatgcttgtttcatttttgtctaaagagtctcctgcaatcattccagaaattttgtctgtacgattataggaatctattataccatttctcaatctcttagcctcatacagaccaactgatgttaaccctaaagagcttcctgtataatccgaaaacccattgtacaaaggtttgttctgaaataaatctaggtattcgcaacctaatctgcattttataagattatcaatagatgggcgtgcaatgcaattctggttctctatgcaatcattaggaccttctataacaatattagtgccaaagatactttctatgatcttgtcttcttttacattgcagtaacattgatctttttcagggcatttttcaaatttgcttgtaaccaaaaatggacagcctggaacataaaagcatccactcaaacattgggttgtttgagccatagacatgggcatctgagacaaaatgactaaacctatcaaaatttcggtcacaaattttagcaaactcaagctcagcttagtgttcactattagatggaaccattccatgctagtccacttatgtttgttgtagtcatgatctacctctttggacaatatgggacactctgaagaatgctcttttgaagctttgcttttgttgcaaatgcagactttagtacactcatgtgtgactatgcacaaattgccgcagttagaacatttaaatgggaaatatttccataagcaatttatgagcaataagacagggtatgtgatcaagcccataagatcataccagagaaagagaggtttagtcgtcttgttcactaaccatcggatagggaaatagatcaacaaagctatcaatatcaatcttatccaagaaaaattgatgcaggctgtttgcttataaatactttttgaatatttgattatgcaatctctgactcttttgtttgtttttggtattttagctgatttgtcaccgcacaagagattgtgttcaccatccaacatttcctcggtaaaagtgatacttgctgatccagaaaaagctataaccttgtgttccacattttcaccaggtttttttatcaaataacccatgatcttctcagggctagtgatgctcacagtatagggatttgcaaagtttgatttagttattttgcagtcaccagataactttacagtttgtaatgatactgttccattagtggggtatgagttgtaagttataggataattatcttgtgtcaggctttctgaaatgaagaattttgttcctactgaaaaatgtcttttgttgtcaagtttggtaataggaataactgggactttggagaatctctttggcaaatttaaagaattatcacatttttctaaaccttctgctgaatcagaaacacaggaatatatgacaccattgttttcaacttgataataaacattataagtagatatcccttttatctcacattttaatgaggaagcattcaagcagttgttgggaagatccaaaacagagattgttttttgcgttgctggctcagtggaaatagggatggttgatttttcttctcgtatctgacgggttccaggagtccgagattctagcatcagattagttaaagtctccaagatagcttcgcgttgaatcgatgcagcagtgggtacctcattctcagcagaatcatcataaatctcaggatgatctccacgaattatttctactttagcatctgtggctctgaagatcaagaatgccaacaaaacagaactcagggcaattgtgaaaagactcacttttaccactagttctagtagttttagaattctcatcttagatgtctacccagattacaatggttgtgtgattaatttcaagatgtctggattaaggtttttgtttgcactgattgctct

SEQ ID NO: 287 - DNA, 4773 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaaaggatgaaggtcctttagtttcacttgctaaacataatggtaatgttgaagtctctaagccatggtcttcttctgatgaaaagcttgctttgactaaagctatggatacatccaaaggaaagatactgttgaacacagagggaacatcttccttcggaacctatgaatctgattctatcacagaatcagagggttatgatctttctgcaagaatgatagtagatacaaaccatcatatctcaaactggaaaaatgatctttttgttggcaacgggaagcaaaacgcaaataaggtcatcaagatctgtccaacttgggacagcagaaaacaatacatgatgatttccaggattgtgatatgggtctgccccactataccaaaccctacaggaaaacttgtggttgccctggttgatcccaacatgccatctgaaaagcaagtcattctgaagggtcaggggacaataattgatcctatatgttttgtcttttatctgaactggtctattccgaaaatgaataacactccagaaaactgctgtcagctgcatttgatgtgcagccaagaatacaagaagggggtttcttttggtagtatcatgtattcttggacaaaggagttttgtgattcacccagagctgataaagataaaagttgcatggtcatacctctaaacagagctattagagctagatctcaagcattcattgaggcttgcaagctgataatccctaaaggaaacagtgaaaagcagattaaaaaacagcttaaagaattgagcttaaatcttgagagatcagttgaagaagaagaggaagggatttctgatagtgttgctcagttatcttttgatgaaatatagtacttttaatgtcacttatttaagcttaaatttctgttaattttgcatttaaatcgaaaaccaaaacaaaaaacaagaagaaaaaacaaaaaatcaaaaacaaaaaacaaaaacaaataaggctgaaaagccaaactttggtccgaagactctttttgttgttttttgtttatttgtatatatatttttttgtttgttttttatttattttatacatgcataatctgactaatgcaaaagattgaatcaaattcagcctgtgacaagcagactcagacaaggtgagagaaatccataggtggccttcgtcttgtcattgtatctttcattaacataggggcgttgatttcagaatcatcatcatcctctaccttggatctagatttataagattcatttttgacataccctttacaaatggttgttagaatagaacagaaataaatcacaaggaaaatgaatgcaataagcaatattactctgatagtatcaaaaaatgagccgaaataacttgcaatgaaattgaatgggcttttaatataatcccagaagccccatgctgaagaatcagaattatattgttgttcttcatgagcatactcatcattttgatctattatgttctctggttcttctacaacaacattattgaccaaaacttccacagaaatatccggattgccttctggatacaacgtcattttcttcttatccggattagcagaacaaaacattgttatgttgtatttattagatccttttttaacagccagctgataagtagatagagagcaagcatctacagaaattgcagtagaaaatgtcaaatctgagaaaaattccaaaacgcaagataaaccttgaccgcatagaaggcagccgttgcaatttaagcttgttgaagttatggaaggtctcttaggagcaactttaaaaagatctgatggaagatcaacgacaatcttgagtttccctagactgaaagctttttccaagaaaaaactagagaaatctttgaaactaacgggaatatctgatatttgctctaaaccagatctaaatctgtatgtgtcatatccgcatgttttaatagtgattgattttttccctatcgctgcacaatcccaagacatatcatctccttctagagttttcttagtaaaaataggcactccatcatgagtcaattgtgggtgaccaaacattttcacaggatcattcaagtttgcaatatttccagaataaatatggctgtcaggtccatgggctatcagttcacctatagtgataccatcattgtgcaaatctgcttgtatatcagcttgaaacaaggcattttcataaggaacctcttcagtaatccttgagcacagacctcctaaaataccagaaatacaaacatctgccactatagttgatttcagcactgaataaattctgtacgatttatccatgtcatagatattccgacagaatccgcatgtagcaccttcattaattgcaaaacaccaagcttcttcacatccccaataagaagttggtgttatacaaaaatcttggaaaccagttaaagcttgattttttctgcaggtgtcacagtttcctgtacaagtggaataaaaatctgtgtgggtgctttggataggagctgttgtgtatttttctgacacttcataatgaattcccacacttttgatataaatcacaaatttttttgctgtttctgaggtcttatcatttaacatgaatatagtccctcctcctcctaaaagagattgttctatcatgtatctatatttcccgtccacaacagaatcaaagatcaatgattgtctaggcagaatgttctctggtatgcttgtttcgtttttgttcagagaatctcctgcaatcattccagaaattttatctgtacgattataagaatctattataccattcctcaatctcttagcctcatacagaccaaccgatgttaaccctaaagagcttcctgtataatctgaaaacccattatacaaaggtttgttccgaaataaatctaggtactcgcaacccagtctgcattttataagattatcaatagacgggtctgcagcacaattctggttctctatgcaatcatttggaccttctataacaatgttagtgccaaagatactttctataatcttgtcttctttcacattacagtaacattgatctttttctgggcatttttcaaatttgcttgtaaccaaaaatggacagcctggaacataaaaacatccactcaaacattgggtagtttgagccatagacatgggcatttgagacaaaatgatcatacctattaagatttcagttacaaatttcagcaaactaaagctcagcttagtgttcactattagatggaaccactccatgctagtccacttgtgtttgttgtagtcatgatctgcttctttggacaatatggggcactctgaagaatgttcttttgaagctttgcttttgttgcagatgcaaattttagtacattcatgtgtgattatgcacaaattgccacagttagaacatttaagtggaaaatatttccataagcagtttatgagcaacaaaatagggtatgtgatcaagcctatgagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaggagattgtgctcaccatccaacatttcttcagtaaaagtgatgcttgctgatccagaaaaggatatgaccttgtgctccacattttcaccaggcttttttactaaataacccatgatcttctcggggctagtgatgctaacagtatagggattggcaaagttcgatttagttattttgcagtcaccagataactttacagtttgtaatgatactgttccattagtagggtacgagttataggttataggataattatcttgtgtcaggctttctgaaatgaagaattttgttccaactgaaaaatgccttttgttgtcaagtttggtaatgggtataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccaagacagagattgttttttgtgtagttgactcagcaaaaatagggatggttgattcttcttcccgtatttgacgggttccaggagtctgagattctagcatcagattagtcaaagtctccaagatagccttgcgttgaatcgatgcagcagtgggtacttcattctcagcagaatcatcataaacctcaggatggtctccacgaattatttctactttggcatctgtggctctgaaggtcaagaatgccaacaagacagaactcagggcaattgtgaaaagactcacttttaccactagttctagtagttttaaaattttcatcttagacgtctgctcagattataatggttatatgattaatttcaagatgtctggattaaggtttttgtttgcactgattgctct

SEQ ID NO: 288 - DNA, 4787 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaaaggacgaaggtcctttagtttcacttgctaaacataatggtaatgttgaagtctctaagccatggtcttcttctgatgaaaagcttgctttgactaaagctatggatacatccaaaggaaagatactgttgaacacagaaggaacatcttcctttggaacctatgaatctgattctatcacagaatcagagggttacgatctttctgcaagaatgatagtagatacaaaccatcatatctcaaactggaaaaatgatctttttgttggcaacgggaaacaaaacgcaaataaggtcatcaagatctgtccaacttgggacagcagaaaacaatacatgatgatttccaggattgtgatatgggtctgccccactataccaaaccctacaggaaaacttgtggttgccctggttgatcccaacatgccatctgagaagcaagtcattctgaagggtcaggggacaataattgatcctatatgttttgtcttttatctgaactggtctattccgaaaatgaataacactccagaaaactgctgtcagctgcatttgatgtgcagccaagaatacaagaagggggtttcttttggtagtatcatgtattcttggacaaaggagttttgtgattcacccagagctgataaagataaaagttgcatggttatacctctaaacagagctattagagctagatctcaagcattcattgaggcttgcaagctgataatccctaaaggaaacagtgaaaagcagattaaaaaacagcttaaagaattgagcttaaatcttgagagatcagttgaagaagaagaggaagggatttctgatagtgttgctcagttatcttttgatgaaatatagtacttttaatgtcacttatttaagcttaaatttctgttaattgtgcatttaaatcgaaaaccaaaacaaaaaacaagaagaaaaaacaaaaaatcaaaaacaaaaaacaaaaacaaaataaggctgaaaagccaaactttggtccgaagactctttttgttgttttttgtttatttgtatatatattttttgtttgttttttatttattttatacatacataatctgactaatgtagaagattggatcaaattcagcctgtgacaagcagactcagacaaggtgagagaaatccataggtggccttcgtcttgtcattgtatctttcattaacataggggcgttgatttcagaatcatcatcatcctctatcttggatctagatttataagattcatttttgacatatcccttacaaatggttgttagaatagaacagaaataaatcacaaggaaaatgaatgcaataagcaatatcactctgatagtatcaaaaaatgagccaaaataacttgcaatgaaattgaatgggcttttaatataatcccagaagccccatgctgaagaatcagaattatattgttgttcttcatgagcatactcatcattttgatctattatgttctctggttcttctacaacaacattattgaccagaacttccacagaaatatccggattgccttctggatacaacgtcattttcttcttgtccggattagcagaacaaaacattgttatgttgtatttattagatccttttttaacagccagctgataagtagatagagagcaagcatctacagaaattgcagtagaaaatgtcaaatctgagaaaaattccaaaacgcaagataaaccttgaccgcatagaagacagccgttgcaatttaagcttgttgaagttatggaaggtctcttaggagcaactttaaaaagatctgatggaagatcaacgacaatcttgagtttccctagactgaaagctttttccaagaaaaaactagagaaatctttgaaactaacgggaatatctgatatttgctctaaaccagatctaaatctgtatgtatcatatccgcatgttttaatagtgattgattttttccctatcgctgcacaatcccaagacatatcatctccttctagagttttcttagtaaaaataggcactccatcatgagtcaattgtgggtgaccaaacattttcacaggatcattcaagtttgcaatatttccagaataaatatggctgtcaggcccatgggctatcagttcacctatagtaataccatcattgtgcaaatctgcttgtatatcagcttgaaacaaagcattttcataaggaacctcttcagtaatccttgagcacagacctcctaaaataccagaaatacaaacatctgccactatagttgattttaacactgaataaattctgtatgatttatccatgtcatagatattccgacagaatccacatgtagcgccttcattaattgcaaaacaccaagcttcttcacatccccaataagaagttggtgttatgcaaaaatcttggaaaccagttaaagcttgattttttctgcaagtgtcacagtttcctgtacaagtggaataaaaatctgtgtgggtgctttggataggagctgttgtgtatttttctaacacttcataatgaattcccacacttttgatataaatcacaaatttttttgctgtttctgaggttttatcatttaacatgaatatagtccctcctcctcctaaaagagattgttctatcatgtatctatatttcccgtccacaacagaatcaaagatcaatgattgtctaggcagaatgttctctggtatgcttgtttcatttttgctcagagaatctcctgcaatcattccagaaattttgtctgtacgattataagaatctattataccattcctcaatctcttagcctcatacagaccaaccgatgttaaccctaaagagcttcctgtataatctgaaaacccattatacaaaggtttgttccgaaacaaatctaggtactcgcaacccagtctgcattttataagattatcaatagacgggtctgcaacacaattctggttctctatgcaatcatttggaccttctataacaatgttagtgccaaagatactttctataatcttatcttctttcacattacagtaacattgatctttttctgggcatttctcaaatttacttgtaaccaaaaatggacagcctggaacataaaaacatccactcaaacattgggtagtttgagccatagacatgggcatttgagacaaaatgatcaaacctattaagatttcagttacaaatttcagcaaactaaagctcagcttagtgttcactattagatggaaccactccatgctagtccacttgtgtttgttgtagtcatgatctgcttctttggacaatatgggacactctgaagaatgttcttttgaagctttgcttttgttgcagatgcaaattttagtacattcatgtgtgattatgcacaaattgccacagttagaacatttaagtggaaaatatttccataagcagtttatgagcaacaaaatagggtatgtgatcaagcctatgagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaggagattgtgctcaccatccaacatttcctcagtaaaagtgatgcttgctgatccggaaaaggatatgaccttgtgttccacattttcaccaggcttttttaccaaataacccatgatcttctcggggctagtgatgctaacagtataaggattggcaaagttcgatttagttattttgcagtcaccagataactttacagtttgtaatgacactgttccattagtagggtacgagttataggttataggataattatcttgtgtcaggctttctgaaatgaagaattttgttccaactgaaaaatgccttttgttgtcaagtttggtaatgggaataaccgggactttggagaaactctttggcagatttaaagaattgtcacattttcctaaaccttccgctgaatcagaaacacaggaatatatgacaccattattttccacttgataataaacattataagtggatatcccttttatctcacattttaatgaagaagcattcaagcagttgttaggaagatccgagacagagattgttttttgcgtagttgactcagcaaaaatagggatggttgattcttcttctcgtatctgacgggttccaggagtctgagattctagcatcagattagtcaaagtctccaagatagccttgcgttgaatcgatgcagcagtgggtacttcattctcagcagaatcatcataaacctcaggatggtctccacgaattatttctactttggcatctgtggctctgaaggtcaagaatgccaacaagacagaactcagggcaattgtgaaaagactcacttttaccactagttctagtagttttaaaattctcatcttagacgtctgttcagattataatggttatatgattaatttcaagatgtctggattaaggtttttgtttgcactgattgctctgctctggctacccc

SEQ ID NO: 289 - DNA, 4773 bp, Tomato spotted wilt virus
agagcaatcagtgcgtcagaaatatacctattatacattttgctaagaatcaatcaattacattacacaagctcctctaccttaggctgttgaactcgaaatgttgactcttttcggtaataaggggtcttctaagtctgccagaaaggatgaaggtcctttggtttcacttgctaaacataatggtaatgttgaagtctctaagccatggtcttcttctgatgaaaagcttgctttgactaaagctatggatacatccaaaggaaagatactgttgaacacagagggaacatcttcctttggaacctatgaatctgattctatcacagaatcagagggttacgatctttctgcaagaatgatagtagatacaaaccatcatatctcaaactggaaaaatgatctttttgttggcaacgggaagcaaaacgcaaataaggtcatcaagatctgtccaacttgggacagcagaaaacaatacatgatgatttccaggattgtgatatgggtctgccccactataccaaaccctacaggaaaacttgtggttgccctggttgatcccaacatgccatctgaaaagcaagtcattctgaagggccaggggacaataattgatcctatatgttttgtcttttatctgaactggtctattccgaaaatgaataacactccagaaaactgctgtcagctgcatttgatgtgcagccaagaatacaagaagggggtttcttttggtagtatcatgtattcttggacaaaggagttttgtgattcacccagagctgataaagataaaagttgcatggtcatacctctaaacagagctattagagctagatctcaggcattcattgaggcttgcaagctgataatccctaaaggaaacagtgaaaagcagattaaaaaacagcttaaagaattgagcttaaatcttgagagatcagttgaagaagaagaggaagggatttctgatagtgttgctcagttatcttttgatgaaatatagtacttttaatgtcacttatttaagcttaaatttctgttaattttgcatttaattcgaaaaccaaaacaaaaaacaagaagaaaaaacaaaaaatcaaaaacaaaaaacaaaaacaaataaggctgaaaagccaaactttggtccgaagactctttttgttgttttttgtttatttgtatatatatttttttgtttgttttttatttattttatacatgcataatctgactaatgtagaagattgaatcaaattcagcctgtgacaagcagactcagacaaggtgagagaaatccataggtggccttcgtcttgtcattgtatctttcattaacataggggcgttgatttcagaatcatcatcatcctctaccttggatctagatttataagattcatttttgacatatcctttacaaatggttgttagaatagaacagaaataaatcacaaggaaaatgaatgcaataagcaatatcactctgatagtatcaaaaaatgagccgaaataacttgcaatgaaattgaatgggcttttaatataatcccagaagccccatgctgaagaatcagaattatattgttgttcttcatgagcatactcatcattttgatctattatgttctctggttcttctacaacaacattattgaccagaacttccacagaaatatccggattgccttctggatacaacgtcattttcttcttgtccggattagcagaacaaaacattgttatgttgtatttattagatccttttttaacagccagctgataagtagatagagagcaagcatctatagaaattgcagtagaaaatgtcaaatctgagaaaaattccaaaacgcaagataaaccttgaccgcatagaagacagccgttgcaatttaagcttgttgaagttatggaaggtctcttaggagcaactttaaaaagatctgatggaagatcaacgacaatcttgagtttccctagactgaaagctttttccaagaaaaaactagagaaatctttgaaactaacgggaatatctgatatttgctctagaccagatctaaatctgtatgtatcatatccgcatgttttaatagtgattgattttttccctatcgctgcacaatcccaagacatatcatctccttctagagttttcttagtaaaaataggcactccatcatgagtcagttgtgggtgaccaaacattttcacaggatcattcaagtttgcaatatttccagaataaatatggctgtcaggtccatgggctatcagttcacctatagtgataccatcattgtgcaaatctgcttgtatgtcagcttgaaacaaggcattttcataaggaacctcttcagtaatccttgagcacagacctcctaaaataccagaaatacaaacatctgccactatagttgattttagcactgaataaattctgtatgatttatccatgtcatagatattccggcagaatccgcatgtagcaccttcattaattgcaaaacaccaagcttcttcacatccccaataagaagttggtgtgatacaaaaatcttggaaaccagttaaagcttgattttttctgcaggtgtcacagtttcctgtacaagtggaataaaaatctgtgtgggtgctttggataggagctgttgtgtatttttctaacacttcataatgaattcccacacttttgatataaatcacaaatttttttgctgtttctgaggtcttatcatttaacatgaatatagtccctcctcctcctaaaagagattgttctatcatgtatctatatttcccgtccacaacagaatcaaagatcaatgattgtctaggcagaatgttctctggtatgcttgtttcgtttttgttcagagaatctcctgcaatcattccagaaattttgtctgtacgattataagaatctattataccattcctcaatctcttagcctcatacaggccaaccgatgttaaccctaaagagcttcctgtataatctgaaaacccattatacaaaggtttgttccgaaataaatctaggtactcgcaacccagtctgcattttataagattatcaatagacgggtctgcagcacaattctggttctctatgcaatcatttggaccttctataacaatgttagtgccaaagatactttctataatcttatcttctttcacattacagtaacactgatctttttctgggcatttttcaaatttgcttgtaaccaaaaatggacagcctggaacataaaaacatccactcaaacattgggtagtttgagccatagacatgggcatttgagacaaaatgatcatacctattaagatttcagttacaaatttcagcaaactaaagctcagcttagtgttcactattagatggaaccactccatgctagtccacttgtgtttgttgtagtcatgatctgcttctttggacaatatgggacactctgaagaatgttcttttgaagctttgcttttgttgcagatgcaaattttagtacattcatgtgtgattatgcacaaattgccacagttagaacatttaagtggaaaatatttccataagcagtttatgagcaacaaaatagggtatgtgatcaagcctatgagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaggagattgtgctcaccatccaacatttcttcagtaaaagtgatgcttgctgatccagaaaaggatatgaccttgtgttccacattttcaccaggcttttttactaaataacccatgatcttctcggggctagtgatgctaacagtatagggattggcaaagttcgatttagttattttgcagtcaccagataactttacagtttgtaatgatactgttccattagtagggtacgagttataggttataggataattatcttgtgtcaggctttctgaaatgaagaattttgttcctactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccaagacagagattgttttttgtgtagttgactcagcaaaaatagggatggttgattcttcttctcgtatttgacggattccaggagtctgagattccagcatcagattagtcaaagtctccaagatagccttgcgttgaatcgatgcagcagtgggcacttcattctcagcagaatcatcataaacctcaggatggtctccacgaattatttctactttggcatctgtggctctgaaggtcaagaatgccaacaagacagaactcagggcaattgtgaaaagactcacttttaccactagttctagtagttgtaaaattctcatcttagacgtctgctcagattataatggttatatgattaatttcaagatgtctggattaaggtttttgtttgcactgattgctct

SEQ ID NO: 290 - DNA, 4774 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaaaggatgaaggtcctttggtttcacttgctaaacataatggtaatgttgaagtctctaagccatggtcttcttctgatgaaaagcttgctttgacgaaagctatggatacatccaaaggaaagatactgttgaacacagagggaacatcttcctttggaacctatgaatctgattctatcacagaatcagagggttacgatctttctgcaagaatgatagtagatacaaaccatcatatctcaaactggaaaaatgatctttttgttggcaacgggaagcaaaacgcaaataaggtcatcaagatctgtccaacttgggacagcagaaaacaatacatgatgatttccaggattgtgatatgggtctgccccactataccaaaccctacaggaaaacttgtggttgccctggttgatcccaacatgccatctgaaaagcaagtcattctgaagggtcaggggacaataattgatcctatatgttttgtcttttatctgaactggtctattccgaaaatgaataacactccagaaaactgctgtcagctgcatttgatgtgcagccaagaatacaagaagggggtttcttttggtagtatcatgtattcttggacaaaagagttttgtgattcacccagagctgataaagataaaagctgcatggtcatacctctaaacagagctattagagctagatctcaagcattcattgaggcctgcaagctgataatccctaaaggaaacagtgaaaagcagattaaaaaacagcttaaagaattgagcttaaatcttgagagatcagttgaagaagaagaggaagggatttctgatagtgttgctcagttatcttttgatgaaatatagtacttttaatgtcacttatttaagcttaaatttctgttaattttgcatttaattcgaaaaccaaaacaaaaaacaagaagaaaaacaaaaaatcaaaaacaaaaaacaaaaacaaaataaggctgaaaagccaaactttggtccgaagactctttttgttgttttttgtttatttgtatatatatttttttgtttgttttttatttattttatacatgcataatctgactaatgtagaagattgaatcaaattcagcctgtgacaagcagactcagacaaggtgagagaaatccataggtggccttcgtcttgtcattgtatctttcattaacataggggcgttgatttcagaatcatcatcatcctctaccttggatctagatttataagattcatttttgacatatcctttacaaatggttgttagaatagaacagaaataaatcacaaggaaaatgaatgcaataagcaatatcactctgatagtatcaaaaaatgagccgaaataacttgcaatgaaattgaatgggcttttaatataatcccagaagccccatgctgaagaatcagaattatattgttgttcttcgtgagcatactcatcattttgatctattatgttctctggttcttctacaacaacattattgaccagaacttccacagaaatatccggattgccttctggatacaacgtcattttcttcttgtccggattagcagaacaaaacattgttatgttgtatttattagatccttttttaacagccagctgataagtagatagagagcaagcatctatagaaattgcagtagaaaatgtcaaatctgagaaaaattccaaaatgcaagataaaccttgaccgcatagaagacagccgttgcaatttaagcttgttgaagttatggaaggtctcttaggagcaactttaaaaagatccgatggaagatcaacgataatcttaagtttccctagactgaaagctttttccaagaaaaaactagagaaatctttgaaactaacaggaatatctgatatttgctctaaaccagatctaaatctgtatgtatcatacccgcatgttttaatagtgattgattttttccctatcgctgcacaatcccaagacatatcatctccttctagagttttcttagtaaaaataggcactccatcatgagtcaattgtgggtgaccaaacattttcacaggatcattcaagtttgcaatatttccagaataaatatggctgtcaggtccatgggctatcagttcacctatagtgataccatcattgtgcaaatctgcttgtatatcagcttgaaacaaggcattttcataaggaacctcttcagtaatccttgagcacagacctcctaaaataccagaaatacaaacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcttggaaaccggttaaagcttgattttttctgcaggtgtcacagtttcctgtacaagtggaataaaaatctgtgtgggtgctttggataggagctgttgtgtatttttctaacacttcataatgaattcccacacttttgatataaatcacaaatttttttgctgtttctgaggtcttatcatttaacatgaatatagtccctcctcctcctaaaagagattgttctatcatgtatctatatttcccgtccacaacagaatcaaagatcaatgattgtctaggcagaatgttctctggtatgcttgtttcgtttttgttcagagaatctcctgcaatcattccagaaattttgtctgtacgattataagaatctattataccattcctcaatctcttagcctcatacagaccaaccgatgttaaccctaaagagcttcctgtataatctgaaaacccattatacaaaggtttgttccgaaataaatctaggtactcgcaacccagtctgcattttataagattatcaatagatgggtctgcagcacaattctggttctctatgcaatcatttggaccttctataacaatgttagtgccaaagatactttctataatcttatcttctttcacattacagtaacactgatccttttctgggcatttttcaaatttgcttgtaaccaaaaatggacagcctggaacataaaaacatccactcaaacattgggtagtttgagccatagacatgggcatttgagaaaaaatgatcatacctattaagatttcagttacaaatttcagcaaactaaagctcagcttagtgttcactattagatggaaccactccatgctagtccacttgtgtttgttgtagtcatgatctgcttctttggacaatatgggacactctgaagaatgttcttttgaagctttgcttttgttgcagatgcaaattttagtgcattcatgtgtgattatgcacaaattgccacagttagaacatttaagtggaaaatatttccataagcagtttatgagcaacaaaatagggtatgtgatcaagcctatgagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccacacaggagattgtgctcaccatccaacatttcttcagtaaaagtgatgcttgctgatccagaaaaggatatgaccttgtgttccacattttcaccaggcttttttactaaataacccatgatcttctcggggctagtgatgctaacagtatagggattggcaaagttcgatttagttattttgcagtcaccagataactttacagtttgtaatgatactgttccattagtagggtacgagttataggttataggataattatcttgtgtcaggctttctgaaatgaaaaattttgttccaactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccaagacagagattgttttttgcgtagttgactcagcaaaaatagggatggttgattcttcttctcgtatttgacgggttccaggagtctgagattctagcatcagattagtcaaagtctccaagatagccttgcgttgaatcgatgcagcagtgggcacttcattctcagcagaatcatcataaacctcaggatggtctccacgaattatttctactttggcatctgtggctctgaaggttaagaatgccaacaagacagaactcagggcaattgtgaaaagactcacttttaccactagttctagtagttgtaaaattctcatcttagacgtctgctcagattataatggttatatgattaattgcaagatgtctggattaaggtttttgtttcgcactgattgctct

SEQ ID NO: 291 - DNA, 4774 bp, Tomato spotted wilt virus
agagcaatcagtgcgtcagaaatatacctattatacactttgctaagaatcaatcaattacattacacaagctcctctaccttaggctgttgaactcaaaatgttgactcttttcggtaataaggggtcttctaagtctgccagaaaggatgaaggtcctttggtttcacttgctaaacataatggcaatgttgaagtctctaagccatggtcttcttctgatgaaaagcttgctttgactaaagctatggatacatccaaaggaaagatactgttgaacacagagggaacatcttcctttggaacctatgaatctgattctatcacagaatcagagggttacgatctttctgcaagaatgatagtagatacaaaccatcatatctcaaactggaaaaatgatctttttgttggcaacgggaagcaaaacgcaaataaggtcatcaagatctgtccaacttgggacagcagaaaacaatacatgatgatttccaggattgtgatatgggtctgccccactataccaaatcctacaggaaaacttgtggttgccctggttgatcccaacatgccatctgaaaagcaagtcattctgaagggtcaggggacaataattgatcctatatgttttgtcttttatctgaactggtctattccgaaaatgaataacactccagaaaactgctgtcagctgcatttgatgtgcagccaagaatacaagaagggggtttcttttggtagtatcatgtattcttggacaaaggagttttgtgattcacccagagccgataaagataaaagttgcatggtcatacctctaaacagagctattagagctagatctcaagcattcattgaggcctgcaagctgataatccctaaaggaaacagtgaaaagcagatcaaaaaacagcttaaagaattgagcttaaatcttgagagatcagttgaagaagaagaggaagggatttctgatagtgttgctcagttatcttttgatgaaatatagtacttttaatgtcacttatttaagcttaaatttctgttaattttgcatttaattcgaaaaccaaaacaaaaaacaagaagaaaaaacaaaaaatcaaaaacaaaaaacaaaaacaaaataaggctgaaaagccaaactttggtccgaagactctttttgttgttttttgtttatttgtatatatatttttttgtttgttttttatttattttatacatgcataatctgactaatgtagaagattgaatcaaattcagcctgtgacaagcagactcagacaaggtgagagaaatccataggtggccttcgtcttgtcattgtatctttcattaacataggggcgttgatttcagaatcatcatcatcctctaccttggatctagatttataagattcatttttgacatatcctttacaaatggttgttagaatagaacagaaataaatcacaaggaaaatgaatgcaataagcaatatcactctgatagtatcaaaaaatgagccaaaataacttgcaatgaaattgaatgggcttttaatataatcccagaagccccatgctgaagaatcagaattatattgttgttcttcatgagcatactcatcattttgatctattatgttctctggttcttctacaacaacattattgaccagaacttccacagaaatatccgaattgccttctggatacaacgtcattttcttcttgtccggattagcagaacaaaacattgttatgttgtatttattagatccttttttaacagccagctgataagtagatagagagcaagcatctatagaaattgcagtagaaaatgtcaaatctgagaaaaattccaaaacgcaagataaaccttgaccgcatagaagacagccgttgcaatttaagcttgttgaagttatggaaggtctcttaggagcaactttaaaaagatctgatggaagatcaacgacaatcttgagtttccctagactgaaagctttttccaagaaaaaactagagaaatctttgaaactaacgggaatatctgatatttgctctaaaccagatctaaatctgtatgtatcatatccgcatgttttaatagtgattgattttttccctatcgctgcacaatcccaagacatatcatctccttctagagttttcttagtaaaaataggcactccatcatgagtcaattgtgggtgaccaaacattttcacaggatcattcaagtttgcaatatttccagaataaatatggctgtcaggtccatgggctatcagttcacctatagtgataccatcattgtgcaaatctgcttgtatatcagcttgaaacaaggcattttcataaggaacctcttcagtaatccttgagcacagacctcctaaaataccagaaatacaaacatctgccactatagttgattttagcactgaataaattctgtatgatttatccatgtcatagatattccgacagaatccgcatgtagcaccttcattaattgcaaaacaccaagcttcttcacatccccaataagaagttggtgttatacaaaaatcttggaaaccagttaaagcttgattttttctgcaggtgtcacagtttcctgtacaagtggaataaaaatctgtgtgggtgctttggataggagctgttgtgtatttttctaacacttcataatgaattcccacacttttgatataaatcacaaatttttttgctgtttctgaggtcttatcatttaacatgaatatagtccctcctcctcctaaaagagattgttctatcatgtatctatatttcccgtccacaacagaatcaaagatcaatgattgtctaggcagaatgttctctggtatgcttgtttcgtttttgctcagagaatctcctgcaatcattccagaaattttgtctgtacgattataagaatctattataccattcctcaatctcttagcctcatacagaccaaccgatgttaaccctaaagagcttcctgtataatctgaaaacccattatacaaaggtttgttccgaaataaatctaggtactcgcaacccagtctgcattttataagattatcaatagacgggtctgcagcacaattctggttctctatgcaatcatttggaccttctataacaatgttagtgccaaagatactttctataatcttatcttctttcacattacagtaacactgatctttttctgggcatttttcaaatttgcttgtaaccaaaaatggacagcctggaacataaaaacatccactcaaacattgggtagtttgagccatagacatgggcatttgagacaaaatgatcatacctattaagatttcagttacaaatttcagcaaactaaagctcagcttagtgttcactattagatggaaccactccatgctagtccacttgtgtttgttgtagtcatgatctgcttctttggacaatatgggacactctgaagaatgttcttttgaagctttgcttttgttgcagatgcaaattttagtacattcatgtgtgattatgcacaaattgccacagttagaacatttaagtggaaaatatttccataagcagtttatgagcaacaaaatagggtatgtgatcaagcctatgagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaggagattgtgctcaccatccaacatttcttcagtaaaagtgatacttgctgatccagaaaaggatatgaccttgtgttccacattttcaccaggcttttttactaaataacccatgatcttttcggggctagtgatgctaacagtatatggattggcaaagttcgatttagttattttgcagtcaccagataactttacagtttgtaatgatactgttccattagtagggtacgagttataggttataggataattatcttgtgtcaggctttctgaaatgaagaattttgttccaactgaaaaatgccttttgttgtcaagtttggtaatgggaataaccgggactttggagaatctctttggcagatttaaagaattgtcacatttttctaaaccttccgctgaatcagaaacacaggaatatatgacaccattattttccacttgataataaacattataagtggatatcccttttatctcacattttaatgaagaagcattcaagcagttgttaggaagatccaagacagagattgttttttgcgtagttgactcaacaaaaatagggatggttgattcttcttctcgtatttgacgggttccaggagtctgagattctagcatcagattagtcaaagtctccaagatagccttgcgttgaatcgatgcagcagtgggcacttcattctcagcagaatcatcataaacctcaggatggtctccacgaattatttctactttggcatctgtggctctgaaggtcaagaatgccaacaagacagaactcagggcaattgtgaaaagactcacttttaccactagttctagtagttgtaaaattctcatcttagacgtctgctcagattataatggttatatgattaatttcaagatgtctggattaaggtttttgtttgcactgattgctct

SEQ ID NO: 292 - DNA, 4782 bp, Tomato spotted wilt virus
agagcaatcagtgcgtcagaaatatacctattatacactttgctaagaatcaatcaattacattacacaagctcctctacctcaggctgttgaactcaaaatgttgacttttttcggtaataaggggtcttctaagtctgccaaaaaggatgaaggtcctttagtttcactagctaaacataatggtaatgtagaagtctcaaaaccatggtcttcttctgatgaaaagcttgctttgactaaagctatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaatgggaagcagaacgctaataaggtcatcaagatctgtccaacttgggacagcagaaaacaatacatgatgatttccaggattgtgatatgggtctgccccactataccaaaccctacagggaaacttgtggttgccctagttgatcccaacatgccatctgaaaagcaaatcattctgaagggtcaagggacaataactgatcctatatgttttgtcttttatctgaactggtctattccaaaaataaacaacactccagaaaactgctgtcagctgcatttgatgtgcagccaagaatacaagaagggggtttcttttggtagtgtcatgtattcttggacaaaggagttttgtgattcacccagagctgataaagacaaaagttgtgtggttatacctctaaacagagctattagagctagatctcaagcattcattgaggcttgcaagctgataattcctaaaggaaacagtgagaagcagattaaaaaacagcttaaagagttgagctcaaatcttgagagatcagttgaagaagaagaggaagggatttctgatagtgttgctcagttatcttttgatgaaatatagtacttttaataccacttattcaagcttaaatttctgttaattttgcattttaaaatcaaaaaacaaaacaaaaaacaaaaaacaaaaagaaaaacaaaaaacaaaaaaatcaaaaacagaaaacaaaaacaaaataaggctgaaaagccaaactttggtccgaagactctttttgttgttttttgtttatttgtattttttgtttgtttttgtttattttatatatacataatatgactaatgtagaaaattgaatcaaatttagcctgtgacaagcagcctcagacaaggtgagagaaatccataggtggccttcgtcttgtcattgtatctttcattaacataagggctttgatctcagaatcatcatcatccactatcttggatctagatttataagattcattcttgacatatcctttacaaatggttgttagaatagaacagaaataaatcacaaggaaaatgaatgcaataagcaatatcactctgatagtatcaaaaaacgagccaaaataacttgcaatgaaattgaatgggctcttaatataatcccagaaactccatgctgaagaatcagaattatattgttgttcttcatgagcatactcatcattttgatctattatgttctctggttcttctacgacaacattattgaccagaacctccacagaaatatctggattgccttctggatacaacgtcattttcttcttgttcggattggcagaacaaaacattgttatgttgtatttatttgacccttttttaacagccagttgataagtagatagagagcaagcatctatagaaattgaagtagaaaatgtcaaatccgagaagaattctaagatgcaagataaaccttgaccgcatagaagacagccattgcaatttaatcttgttgaagttatggaaggtctcttaggagcaactttaaaaagatcagatggaagatcaacgacaatcttgagtttgcctaaactgaaagctttttccaagaaaaaactagagaaatctttgaaactaacaggaatatctgatatttgctctaaaccagatctaaatctgtatgtatcatatccgcatgttttaatagtgattgattttttccctattgctgcacaatcccaagacatgtcatctccttctagagttttcttagtaaaaataggcactccatcatgagtcaattgtgggtgaccaaacattttgacaggatcattcaagtttgcaatatttccagaataaatatggccatcaggtccatgagctatcagttcacctatagtaataccatcattgtgcagatctgcttgtatatcagcttgaaacaaggcattttcataaggaacctcttcagtgatccttgagcactgacctcctaaaataccagaaatacaaacatctgccactatagttgattttagcactgaataaattctgtatgatttatccatgtcatagatattccgacagaatccacatgtagcaccttcattaattgcaaaacaccaagcttcttcacatccccaataagaagttggtgttatacaaaaatcttggaaacctgtcaaagcttgattttttctgcaagtgtcacagtttcctgtacaagttgaataaaaatctgtgtgagtactttggataggggctgttgtgtatttttctgacacttcataatgaattcccacacttttgatataaatcacaaattttttggctgtttccgaggtcttatcattcaacatgaatatagtccctcctcctcctaaaagagattgttctatcatgtatctatatttcccgtctacaacagaatcaaagatcaatgattgtctaggcagaatgttctctggtatgcttgtttcatttttgtttagagagtctcctgcaatcattccagaaattttgtctgtacgattataagaatctattataccattcctcaatctcttagcttcatacagaccaaccgatgttaaccctaaagagcttcctgtataatctgaaaatccgttatacaaaggtttgtttctaaataaatctaggtattcgcaacctaatctgcattttataagattatcaatagatgggtgtgcaatgcaattctggttctctatgcaatcattaggaccttctataacaatgttagtgccaaagatactttctataatcgtatcttcttttacattacagtaacattgatctttttcagggcatttttcaaatttgcttgtaaccaaaaacggacagcctggaacataaaaacacccacttaaacattgggtagtttgagccatagacatgggcatttgagacaaaattaccaaacctattaagatttcagtcacaaatttcagcaaactaaagctcagcttagtgttcactattagatggaaccattccatgctagtccacttatgtttgttgtagtcatgatctgtttctttggacaatatgggacactctgaagaatgttcttttgaagctttgcttttgttgcagatgcaaattttagtacattcatgtgtgattatgcacaaattgccacagttagaacatttaaatggaaaatatttccataagcaatttatgagcaacaaaatagggtatgtgatcaagcctataagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagctgatttgtcaccgcacaagagattgtgctcaccatccaacatttcctcagtaaaagtgatgcttgctgatccagaaaaagatatgaccttgtgttccacattttcaccaggcttttttatcaaataacccatgatcttctcagggctagtgatgctaacagtgtagggattagcaaagtttgatttagttattttgcagtcgccagataacttcacagtttgtaatgatactgttccattagtagggtacgagttataagttataggataattatcttgtgtcaggctttctgaaatgaagaattttgttccaactgaaaaatgccttttgttgtcaagtttagtaatgggaataaccgggactttagagaatctttttggcagatttaaagaattgtcacatttttctaaaccttctgctgaatcagaaacacaggaatatatgacaccattattttccacttgataataaacattataagtggataccccctttatctcacattttaatgaagaagcattcaagcagttgttaggaagatccgagacagaaatcgttttttgcgtagttgattcagcaaaaatagggatggttgattcttcttctcgtatctggcgggttccaggagtctgagattctagcatcagattagttaaagtctccaagatagccttgcgttgaattgatgcagcagtgggtacttcattctcagcagaatcatcataaacctcaggatggtctccacgaattgtttctactttggcatctgtggctctgaagatcaagaatgccaacaagacagaactcagggcaattgtgaaaagactcacttttaccactagttctagtagttttaaaattctcatcttagacgtctgctcagattataatggttatatgattaatttcaagatgtctggattaaggtttttgtttgcactgattgctct

SEQ ID NO: 293 - DNA, 4785 bp, Tomato spotted wilt virus
agagcaatcagtgcgtcagaaatatacctattatacactttgctaagaatcaatcaattacattacacaagctcctctaccttaggctgttgaactcaaaatgttgacttttttcggtaataaggggtcttctaagtctgccggaaaggatgaaggtcctttagtttcactagctaaacataatggtaatgttgaagtctcaaaaccatggtcttctgctgatgaaaagcttgctttgactaaagctatggatacatccaaaggaaagatactgttgaacacagagggaacatcttcctttggaacctatgaatctgattctatcacagaatcagagggttatgatctttctgcaagaatgatagtagatacaaaccatcatatctcaaactggaaaaatgatctttttgttggcaacgggaagcagaacgctaacaaggtcatcaagatctgtccaacttgggacagcagaaaacaatacatgatgatttctaggattgtgatatgggtctgccccactataccaaaccctacaggaaaacttgtggttgccctagtcgatcccaacatgccatctgaaaagcaagtcattctgaagggtcaggggacaataactgatcctatatgttttgtcttttatctgaactggtctattccaaaaataaacaacactccagaaaactgctgtcagctgcatttgatgtgcagccaagaatacaagaagggggtttcttttggtagtgtcatgtattcttggacaaaggagttttgtgattcacccagagctgataaagacaaaagttgtgtggttatacctctaaacagagctattagagctagatctcaagcattcattgaggcttgcaagctgataattcctaaaggaaacagtgagaagcagattaaaaaacagcttaaagagttgagctcaaatcttgagagatcagttgaagaggaagaagaagggatttctgatagtgttgctcagttatcttttgatgaaatatagtacttttaataccacttatttaagcttaaatttctattaattttgcattttaaaatcaaaaacaaacaaaaacaaaaaacaaaaaagaaaaacaaaaaacaaaaaaatcaaaaaagaaagaaaaaacaaaaacaaaataaggctgaaaagccaaactttggtccgaagactctttttgttgtttttgtttatttgtgttttttgtttgtttcttgtttattttatatatacataatctgactaatgtagagaattaaatcaaatttagcctgtgacaagcagcctcagacaaggtgagagaaatccataggtggccttcgtcttgtcattgtatctttcattaacataggggctttgatctcagaatcatcatcatcctctatcttggatctagatttataagattcattcttaacatatcctttacaaatggttgttagaatagaacagaaataaatcgcaaggaaaatgaatgcaataagcaatatcactctgatagtatcaaaaaacgagccaaaataacttgcaatgaaattgaatgggctcttaatataatcccagaagccccatgctgaagaatcagaattatattgttgttcttcatgagcatactcatcattttgatctattatgttctctggttcttctacaacaacattattgaccagaacctccacagaaatatctggattgccttctggatacaacgtcattttcttcttgtccggattagcagaacaaaacattgttatgttgtatttatttgacccttttttaacagccagttgataagtagatagagagcaagcatctatagaaattgaagtagaaaatgtcaaatccgagaaaaattctaaaatgcaagataaaccttgaccgcatagaagacagccgttgcaatttaatcttgttgaagttatggaaggtctcttaggagcaactttaaaaagatcagatgggagatcaacgacaatcttgagtttgcctaaactgaaagctttttccaagaaaaaactggagaaatctttgaaactaacaggaatatctgatatttgctctaaaccagatctaaatctgtatgtatcatatccgcatgttttaatagtgattgattttttccctattgctgcacaatcccaagacatgtcatctccttctagagttttcttagtaaaaataggcaatccatcatgagtcaattgtgggtgaccaaacattttgacaggatcattcaagtttgcaatatttccagaataaatatggccgtcaggtccatgagctatcagttcacctatagtgataccatcattgtgcaaatctgcttgtatatcagcttgaaacaaggcattttcataaggaacctcttcagtgatccttgagcactgacctcctaaaataccagaaatacaaacatctgccactatggttgattttagcactgaataaattctgtatgatttatccatgtcatagatattccgacagaatccacatgtagcaccttcattaattgcaaaacaccaagcttcttcacatccccaataagaagttggtgttatacaaaaatcttggaaacctgttaaagcttgattttttctgcaagtgtcacagtttcctgtacaagttgaataaaaatctgtgtgagtgctttggataggagctgttgtgtatttttctgacacttcataatgaattcccacacttttgatataaatcacaaattttttggctgtttccgaggttttatcattcaacatgaatatagtccctcctcctcttaaaagagattgttctatcatgtatctatatttcccgtctacaacagaatcaaagatcaatgattgcctgggcagaatgttctctggtatgcttgtttcatttttgtttagagagtctcctgcaatcattccagaaattttgtctgtacgattataagaatctattataccattcctcaatctcttagcctcgtacagaccgaccgatgttaaccctaaagagcttcctgtataatctgaaaatccgttatacaaaggtttgtttctaaataaatctaggtattcgcaacctaatctgcattttataagattatcaatagatggatgtgcaacgcaattctggttctctatgcaatcattaggaccttctataacaatgttagtgccaaagatactttctataatcgtatcttcttttacattacagtaacattgatctttttcagggcatttttcaaatttgcttgtaaccaaaaacggacagcctggaacataaaaacatccacttaaacattgggtagtttgagccatagacatgggcatttgagacaaaatgaccaaacctattaagatttcagtcacaaatttcagcaaactaaagctcagcttagtgttcactattagatggaaccattccatgctagtccacttatgtttgttgtagtcatgatctgtttctttggacaatatgggacactctgaagaatgttcttttgaagctttgcttttgttgcagatgcaaagtttagtacattcatgtgtgattatgcacaaattgccacagttagaacatttaaatggaaaatatttccataagcaatttatgagcaacaaaatagggtatgtgatcaagcctataagatcataccagagaaagaggggtttggttgtcttgtttactaaccaccggatagggaaatagatcaacaaagctatcaatattaatcttatccaagaaaaattgatgcaggctgtttgtttataaatgctttttgaatatttgattatgcaatctctaactcttttgtttgtttttggtattttagcagatttgtcaccgcacaagagattgtgctcaccatccaacatttcctcagtaaaagtgatgcttgctgatccagaaaaagatatgaccttgtgttccacattttcaccaggcttttttatcaaataacccatgatcttctcagggctagtgatgctaacagtatagggattagcaaagtttgatttagttattttgcagtcgccagataatttcacagtttgtaatgatactgttccattagtagggtacgagttataagttataggataattatcttgtgacaggctttctgaaatgaagaattttgttccgactgaaaaatgccttttgttgtcaagtttggtaatggggataaccgggactttagagaatctttttggcagatttaaagaattgtcacatttttctaaaccttctgctgaatcagaaacacaggaatatatgacaccattattttccacttgataataaacattataagtggatatcccttttatctcacattttaatgaagaagcattcaagcagttgttgggaagatccgagacagagattgttttttgcgtagttgattcagcaaaaatagggatggttgattcttcttctcgtatctggcgggttccaggagtctgagattctagcatcagattagttaaagtctccaagatagccttgcgttgaattgatgcagcagtgggtacttcattctcagcagaatcatcataaacctcaggatggtctccacgaattatttctactttggcatctgtggctctgaagatcaagaatgccaacaagacagaactcagggcaattgtgaaaagactcacttttaccactagttctagtagttttaaaattctcatcttagacgtctgctcagattataatggttatatgattaatttcaagatgtctggattaaggtttttgtttgcactgattgctct

SEQ ID NO: 294 - DNA, 4774 bp, Tomato spotted wilt virus
agagcaatcagtgcatcagaaatatacctattatacactttgctaagaatcaatcaattacattacacaagctcctctaccttaggctgttgaactcaaaatgttgactcttttcggtaacaaggggtcttctaagtctgccagaaaggatgaaggtcctttagtttcacttgctaaacataatggtaatgttgaagtctctaagccatggtcttcttctgatgaaaagcttgccttgactaaagctatggatacatccaaaggaaagatactgttgaacacagagggaacatcttcctttggaacctatgaatctgattctatcacagaatcagagggtcacgacctttctgcaagaatgatagtagatacaaaccatcatatctcaaactggaaaaatgatctttttgttggcaacgggaagcaaaacgcaaataaggtcatcaagatctgtccaacttgggacagcagaaaacaatacatgatgatttccaggattgtgatatgggtctgccccactataccaaaccctacaggaaaacctgtggttgccctggttgatcccaacatgccgtctgaaaagcaagtcattctgaagggtcaggggacaataattgatcctatatgttttgtcttttatctgaactggtctattccgaaaatgaataacactccagaaaactgctgtcagctgcatttgatgtgcagccaagaatacaagaagggggtttcttttggtagtatcatgtattcttggacaaaggagttttgtgattcacccagagctgataaagataaaagttgcatggtcatacctctaaacagagctattagagctagatctcaagcattcattgaggcttgcaagctgataatccctaaaggaaacagtgaaaagcagattaaaaaacagcttaaagaattgagcttaaatcttgagagatcagttgaagaagaagaggaagggatttctgatagtgttgctcagttatcttttgatgaaatatagtacttttaatgtcacttatttaagcttaaatttctgttaattttgcatttaaatcaaaaaccaaaacaaaaaacaagaagaaaaaacaaaaaatcaaaaacaaaaaacaaaaacaaaataaggctgaaaagccaaactttggtccgaagactctttttgttgttttttgtttatttgtatatatatttttttgtttgttttttatttattttatacatgcataatctgactaatgtagaagattgaatcaaattcagcctgtaacaagcagactcagacaaggtgagagaaatccataggtggccttcgtcttgtcattgtatctttcattaacataggggcgttgatttcagaatcatcatcatcctctaccttgggtctagatttataagatccatttttgacatatcctttacaaatggttgttagaatagaacataaataaatcacaaggaaaatgaatgcaataagcagtatcactctgatagtatcaaaaaatgagccgaaataacttgcaatgaaattaaatgggcttttaatataatcccagaagccccatgctgaagaatcagaattatattgttgttcttcatgagcatactcatcattttgatctattatgttctctggttcttctacaacaacattattgaccagaacttccacagaaatgtccggattgccttctggatacaatgtcattttcttcttgtccggattagcagaacaaaacattgttatgttgtatttattagatccttttttaacagccagttgataagtagatagagagcaagcatctacagaaattgcagtagaaaatgtcaaatctgagaaaaattccaaaacgcaagataaaccttgaccgcatagaagacagccgttgcaatttaagcttgttgaagttatagaaggtctcttaggagcaactttaaaaagatctgatggaagatcaacgacaatcttgagtttccctagactgaaagctttttccaagaaaaaactagagaaatctttgaaactaacaggaatatctgatatttgctctaaaccagatctaaatctgtatgtatcatatccgcatgttttaatagtgattgattttttccctatcgctgcacaatcccgagacatatcatctccttctagagttttcttagtaaaaataggcgctccatcatgagtcaattgtgggtgaccaaacattttcacaggatcattcaagtttgcaatattaccagaataaatatggctgtcaggtccatgggctatcagttcgcctatagtgataccatcattgtgcaaatctgcttgtatatcagcttgaaacaaggcattttcataaggaacctcttcagtaatccttgagcacagacctcctaaaataccagaaatacaaacatctgccactatagttgattttagtactgaataaattctgtatgatttatccatgtcatagatattccgacagaatccgcatgtagcaccttcattgattgcaaaacaccaagcttcttcacatccccaataagaagttggtgttatacaaaaatcttggaaaccagttaaagcttgattttttctgcaggtgttacagtttcctgtacaagtggaataaaaatctgtgtgggtgctttggataggagctgttgtgtatttttctgacacttcataatgaattcccacacttttgatataaatcacaaatttttttgctgtttctgaggttttatcatttaacatgaatatagtccctcctcctcctaaaagagattgttctatcatgtatctatatttcccgtccacaacagaatcaaagatcaatgattgtctaggcagaatgttctctggtatgcttgtttcgtttttgttcagagaatctcctgcaatcattccagaaattttgtctgtacgattataagaatctattataccattcctcaatctcttagcctcatacagaccaaccgatgttaaccctaaagagcttcctgtataatctgaaaacccattatacaaaggtttgttccgaaataaatctaggtactcgcaacccagtctgcattttataagattatcaatagacgggtctgcagcacaattctggttctctatgcaatcatttggaccttctataacaatgttagtgccaaagatactttctataatcttatcttctttcacattacagtaacattgatctttttctgggcatttttcaaatttgctagtaaccaaaaatggacagcctggaacataaaagcatccactcaaacattgggttgtttgagccatagacatgggcatttgagacaaaatgatcatacctattaagatttcagttacaaatttcagcaaactaaagctcagcttagtgttcactattaggtggaaccactccatgctagtccacttgtgtttgttgtagtcatgatctgcttctttggacaatatgggacactctgaagaatgttcttttgaagctttgcttttgttgcagatgcaaattttagtacattcatgtgtgattatgcacaaattgccacagttagaacatttaagtggaaaatatttccataagcagtttatgagcaacaaaatagggtatgtgatcaagcctatgtgatcataccagagaaagagaggtttggttgtcttgtttactaaccaccggatagggaaatagatcaacaaagctattaatattaatcttatccaagaaaaattgatgcaggctgtttgtttataaatgctttttgaatatttgattatgcaatctctaactcttttgtttgtttttggtattttagctgatttgtcaccgcacaagagattgtgctcaccatccaacatttcttcagtaaaagtgatgcttgctgatccagaaaaggatatgaccttgtgttccgcattttcaccaggcttttttactaaataacccatgatcttttcggggctagtgatgcttacagtatagggattggcaaagttcgatttagttattttgcagtcaccagataactttacagtttgtaatgatactgttccattagtagggtacgagttataggttataggataattatcttgtgtcaggctttctgaaatgaagaattttgttccaactgaaaaatgtcttttgttgtcaagtttggtaatgggaataaccgggactttggagaatctctttggcagatttaaagaattgtcacatttttctaaaccttccgctgaatcagaaacacaggaatatatgacaccattattttccacttgataataaacattaaaagtggatatcccttttatctcacattttaatgaagaagcattcaagcagttgttaggaagatccaagacagagattgttttttgcgtagttgactcagcagaaatagggatggttgattcttcttctcgtatttgacgggttccaggagtctgagattctagcatcagattagtcaaagtctccaagatagccttgcgttgaatcgatgcagcagtgggtacttcattctcagcagaatcatcataaacctcaggatggtctccacggattatttctactttggcatctgtggctctgaaggtcaagaatgccaacaagacagaactcagggcaattgtgaaaagactcacttttaccactagttctagtagttttaaaattctcatcttagacgtctgctcagattataatggttatatgattaatttcaagatgtctggattaaggtttttgtttgcactgattgctct

SEQ ID NO: 295 - DNA, 4763 bp, Tomato spotted wilt virus
agagcaatcagtgcatcagaaatatacctattatacactttgctaagaataaatcaattacattacacaagctcctctaccttaggctgttgaactcaaaatgttgactcttttcggtaataaagggtcttctaagtctgccagaaaggatgaaggtcctttagtttcacttgctaaacataatggtaatgttgaagtctctaagccatggtcttcttctgatgaaaagcttgctttgactaaagctatggatacatccaaaggaaagatactgttgaacacagagggaacatcttcctttggaacctatgaatctgattctatcacagaatcagagggttacgatctttctgcaagaatgatagtagacacaaaccatcatatctcaaactggaaaaatgatctttttattggcaacgggaagcaaaacgcaaataaggtcatcaagatctgtccaacttgggacagcagaaaacaatacatgatgatttccaggattgtgatatgggtctgccccactataccaaaccctacaggaaaacttgtggttgccctggttgatcccaacatgccatctgaaaagcaagtcattctgaagggtcaggggacaataattgatcctatatgttttgtcttttatctaaactggtctattccgaaaatgaataacactccagaaaactgctgtcagctgcatttgatgtgcagccaagaatacaagaagggggtttcttttggtagtatcatgtattcttggacaaaggagttttgtgattcacccagagcagataaagataaaagttgcatggtcatacctctaaacagagctattagagctagatctcaagcattcattgaggcttgcaagctgataatccctaaaggaaacagtgaaaagcagattaaaaaacagcttaaagaattgagcttaaatcttgagagatcagttgaagaagaagaggaagggatttctgatagtgttgctcagttatcttttgatgaaatatagtacttttaatgtcacttatttaagcttaaatttctgttaattttgcatttaaatcgaaaaccaaacaaaaaacaagaagaaaaacaaaaaatcaaacaaaaaacaaaaacaaaataaggctgaaaagccaaactttggtccgaagactctttttgttgttttttgtttatttgtatatatattttcttgtttgtttattttatacatgcataatctgactaatgtaaaagattggatcaaattcagcctgtgacaagcagactcagacaaggtgagagaaatccataggtggccttcgtcttgtcattgtatctttcattaacataggggcgttgatttcagaatcatcatcatcctctaccttggatctagatttataagattcatttttgacataccctttacaaatggttgtcaaaatagaacagaaataaatcacaaggaaaatgaatgcaataagcaataccactctgatagtatcaaaaaatgagccgaaataacttgcaatgaaattgaatgggcttttaatataatcccagaagccccatgctgaagaatcagaattatattgttgttcttcatgagcatactcatcattttgatctattatgttctctggttcttctacaacaacattattgaccaaaacttccacagaaatatccggattgccttctggatacaacgtcattttcttcttatccggatcagcagaacaaaacattgttatgttgtatttattagatccttttttaacagccagctgataagtagatagagagcaagcatctgcagaaattgcagtagaaaatgtcaaatctgagaaaaattccaaaacgcaagataaaccttgaccgcatagaagacagccgttgcaatttaagcttgttgaagttatggaaggtctcttaggagcaactttaaaaagatctgatggaagatcaacgacaatcttgagtttccctagactgaaagctttttccaagaaaaaactagagaaatctttgaaactaacaggaatatctgatatttgctctaaaccagatctaaatctgtatgtatcatatccgcatgttttaatagtgattgattttttccctatcgctgcacaatcccaagacatatcatctccttctagagttttcttagtaaaaataggcactccatcatgagtcaattgtgggtgaccaaacactttcacaggatcattcaagtttgctatatttccagaataaatatggctatcaggtccatgggctatcagtttacctatagtgataccatcattgtgcaaatctgcttgtatatcagcttgaaacaaggcattttcataaggaacctcttcagtaatccttgagcacagacctcctaaaataccagaaatacaaacatctgccactatagttgatttcagcactgaataaattctgtacgatttatccatgtcatagatattccgacagaatccgcatgtagcaccttcattaattgcaaaacaccaagcttcttcacatccccaataagaagttggtgttatacaaaaatcttggaaaccagttaaagcttgattttttctgcaggtgtcacagtttcctgtacaagtggaataaaaatctgtgtgggtgctttggataggagctgttgtgtatttttctgacacttcataatgaattcccacacttttgatataaatcacaaatttttttgctgtttctgaagtcttatcatttaacatgaatatagtccctcctcctcctaaaagagattgttctatcatgtatctatatttcccgtccacaacagaatcaaagatcaatgattgtctaggcagaatgttctctggtatgcttgtttcgtttttgttcagagaatctcctgcaatcattccagaaattttatctgtacgattatgggaatctattataccattcctcaatctcttagcctcatacagaccaaccgatgttaaccctaaagagcttcctgtataatctgaaaacccattatacaaaggtttgttctgaaataaatctaggtactcgcaacccagtctgcattttataagattattaatagatgggactgcagcacaattctggttctctatgcaatcatttggaccttctataacaatgttagtgccaaaaatactttctataatcttgtcttctttcacattacagtaacattgatctttttctgggcatttttcaaatttgcttgtaaccaaaaatggacagcctggaacataaaaacatccacttaaacattgggtagtttgagccatagacatgggcatttgagacaaaatgatcatacctattaagatttcagttacaaatttcagcaaactaaagctcagcttagtgttcactattagatggaaccactccatgctagtccacttgtgtttgttgtagtcatgatttgcttctttggacaatatggggcactctgaagaatgttcttttgaagctttgcttttgttgcagatgcaaattttagtacattcatgtgtgattatgcacaaattgccacagttagaacatttaagtggaaaatatttccataagcagtttatgagcaacaaaatagggtatgtgatcaagcctatgagatcataccagagaaagaggggtttggttgtcttgtttactaaccaccggatagggaaatagatcaacaaagctatcaatattaatcttatccaagaaaaattgatacaggctgtttgtttataaatgctttttgaatatttgattatgcaatctctaactcttttgtttgtttttggtattttagctgatttgtcaccgcacaggagattgtgctcaccatctaacatttcttcagtaaaagtgatgcttgctgatccagaaaaggatatgaccttgtgctccacattttcaccaggcttttttactaaataacccatgatcttctcggggctagtgatgctaacagtatagggattggcaaagttcgatttggttattttgcagtcaccagataactttacagtttgtaatgatactgttccattagtagggtacgagttataggttataggacaattatcttgtgtcaggctttctgaaatgaagaattttgttccaactgaaaaatgccttttgttgtcaagtttggtaatggttataaccgggactttggagaatctctttggcagatttaaagaattgtcacatttttctaaaccttctgctgaatcagaaacacaggaatatatgacaccattattttccacttgataataaacattataagtggatatcccttttatctcacattttaatgaagaagcattcaagcagttgttaggaagatccaagacagagattgttttttgcgtagttgactcagcaaaaatagggatggttgattcttcttcccgtatttgacgggttccaggagtctgagattctagcatcagattagtcaaagtctccaagatagccttgcgttgaatcgatgcagcagtgggtacttcattctcagcagaatcatcataaaccccaggatggtctccacgaattatttctactttggcatctgtggctctgaaggtcaagaatgccaacaagacagaactcagggcaattgtgaaaagactcacttttaccactagttctagtagttttaaatttctcatcttagacgtctgcccagattataatggttatatgattaatttcaagatgtctggattaaggtttttgtttgcactgattgctct

SEQ ID NO: 296 - DNA, 2916 bp, Tomato spotted wilt virus
agagcaattgtgtcagaattttgttcataatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccagctgtattctgattcaagaagcaaagtagtcctttggctatactgcaaagtagggatcttccctgtgaagaagaagagatttctttctcagcatgtgtatatccctatttttgatgatattgattttagcatcaatattgataactctgttctggcactatctgtttgctcaaatacagtcaatgctaacggagtgaaacatcaaggtcatttgaaggttttgtctcctgcccagctccactctattgaatctatcatgaacagatctgatattacagaccgattccagctccaagaaaaagacataattcccaatgacaaatacattgaagctgcaaacaaaggctctttgtcttgtgtcaaagagcatacctataagatcgagatgtgctataatcaggctttaggcaaagtgaatgttctatctcctaacagaaatgtccatgaatggctgtacagtttcaagccaaatttcaatcaagttgaaagcaacaacagaactgtaaattctcttgcagtgaaatctctgctcatgtcagcagaaaacaacatcatgcctaactctcaagcttccactgattctcatttcaagctgagcctctggctaagggttccaaaggttttgaagcaggtttccattcagaaattgttcaaggttgcaggagatgaaacaaacaaaacattttatttatctattgcctgcattccaaaccataacagtgttgagacagctttaaacattactgttatttgcaagcatcagctcccaattcgcaaatgcaaagctccttttgaattatcaatgatgttttctgatttaaaggagccttacaacattgttcatgacccttcataccccaaaggatcggttccaatgctctggctcgaaactcacacatctttgcacaagttctttgcaactaacttgcaagaagatgtaatcatctacactttgaacaaccttgagctaactcctggaaagttagatttaggtgaaagaaccttgaattacagtgaagatgcctacaaaaggaaatatttcctttcaaaaacacttgaatgtcttccatctaacacacaaactatgtcttacttagacagcatccaaatcccttcatggaagatagactttgccagaggagaaattaaaatttctccacaatctatttcagttgcaaaatctttgttaaagcttgatttaagcgggatcaaaaagaaagaatctaaggttaaggaagcgtatgcttcaggatcaaaataatcttgctttgtccagctttttctaattatgttatgtttattttctttctttacttataattatttctctgtttgtcatctctttcaaattcctcctgtctagtagaaaccataaaaacaaaaaataaaaatgaaaataaaattaaaataaaataaaatcaaaaaatgaaataaaaacaacaaaaaattaaaaaacgaaaaaccaaaaagacccgaaagggaccaatttggccaaatttgggttttgtttttgttttttgttttttgttttttattttttattttatttttattttattttatttttattttatttttattttatttattttttgttttcgttgtttttgttattttattatttattaagcacaacacacagaaagcaaactttaattaaacacacttatttaaaatttaacacactaagcaagcacaagcaataaagataaagaaagctttatatatttataggcttttttataatttaacttacagctgctttcaagcaagttctgcgagttttgcctgctttttaaccccgaacatttcatagaacttgttaagagtttcactgtaatgttccatagcaacactccctttagcattaggattgctggagctaagtatagcagcatactctttccccttcttcacctgatcttcattcatttcaaatgctttgcttttcagcacagtgcaaacttttcctaaggcttccttggtgtcatacttctttgggtcgatcccgaggtccttgtattttgcatcctgatatatagccaagacaacactgatcatctcaaagctatcaactgaagcaataagaggtaagctacctcccagcattatggcaagtctcacagactttgcatcatcgagaggtaatccataggcttgaatcaaaggatgggaagcaatcttagatttgatagtattgagattctcagaattcccagtttcttcaacaagcctgaccctgatcaagctatcaagccttctgaaggtcatgtcagtgcctccaatcctgtctgaagttttctttatggtaattttaccaaaagtaaaatcgctttgcttaataaccttcattatgctctgacgattctttaggaatgtcagacatgaaataacgctcatcttcttgatctggtcgatgttttccagacaaaaagtcttgaagttgaatgctaccagattctgatcttcctcaaactcaaggtctttgccttgtgtcaacaaagcaacaatgctttccttagtgagcttaaccttagacatgatgatcgtaaaagttgttatatgctttgaccgtatgtaactcaaggtgcgaaagtgcaactctgtatcccgcagtcgtttcttaggttcttaatgtgatgatttgtaagactgagtgttaaggtatgaacacaaaattgacacgattgctct

SEQ ID NO: 297 - DNA, 2916 bp, Tomato spotted wilt virus; identical to SEQ ID NO: 296

SEQ ID NO: 298 - DNA, 2999 bp, Tomato spotted wilt virus
agagcaattgtgtcataattttattcataatcaaacctcacttagaaaatcacaaaactgtaataagaacacagtaccaataaccataatgtcttcaagtgtttatgagtcgatcattcagacaaaagcttcagtctggggatcaactgcatctggtaaagctgttgtagattcttactggattcatgaacttggtactggttctccactagttcaaacccagctgtattctgattcaagaagcaaaagtagctttggctatactgcaaaggtagggaatcttccctgtgaggaagaagaaattctttctcagcatgtgtatatccctatttttgatgatgttgattttagcatcaatattgatgactctgttctggcactgtctgtttgctccaacacagtcaatactaacggagtgaaacatcaaggtcatttgaaagttttgtctcctgctcagctccactctattggatctaccatgaacggatctgatattacagaccgattccagctccaagaaaaagatataattcccaatgacaggtacattgaagctgtaaacaaaggctctttgtcttgtgttaaagagcatacctataaggtcgagatgtgctacaatcaagctttaggcaaagtgaatgttctatcccctaacagaaatgtccatgaatggctgtacagtttcaagccaaatttcaatcaagttgaaagcaacaacagaactgtaaattctcttgcagtgaaatctctgctcatgtcagcaggaaataacatcatgcctaactctcaggcttttgtcaaagcttccactgattctcatttcaagctgagcctctggctaagagttccaaaggttttgaagcagatttccattcagaaattgttcaaagttgcaggagatgaaactaacaaaacattttatttatctattgcttgcattccaaaccataacagtgttgagacagctttaaacatttctgttatttgcaagcatcagctcccaatccgtaaatttaaagctccttttgaattatcaatgatgttttctgatttaaaggagccttacaacattgttcatgatccttcatatcctcagaggattgttcatgctctgcttgaaactcacacgtcttttgcacaagttctttgcaacaacttgcaagaagacgtgatcatctacactttgaacaactatgagctaactcctggaaagttagatctaggtgaaagaaccttaaattacagtgaagatgtctgcaaaaggaaatatttcctctcaaaaacacttgaatgtcttccatctaacacacaaactatgtcttacttagacagcatccaaatcccttcctggaagatagactttgctaggggagaaattaaaatttctccacaatctgtttcagttgcaaaatctttgttaaagcttgatttaagtgggatcaaaaagaaagaatctaagatttcggaagcatgtgcttcaggatcaaaataatcttgccgtgtccagcttttctaattatgttatgtttattttctttctttacttataattatttctctgttttgtcatttcctttgaatttctcttgtttaatagaaaccataaaacgaaaataaaaaatgaagcaaaaatcaaaaaatgaaacaaaaatcaaaaaatgaaataaaaataacaaaaaaataaaagactaaaaaccaaaaaaattaaaaaacaaaaaaaccaaaaagatcccgaaagggacaattttggccaaatttgggttttgtttttgttttttgttttttgttttttattttttatttttattttttattttttattttttatttttatttttattttatttatttattttattttatttttattcttatttttatttttatttttattttatgttttttgttgtttttgttattttgtttatttattaagcacaacacacagaaagcaaactttaattaaacacacttattttaaatttagcacactaagcaagcataagcaataaagataaagaaagctttatatatttataagcttttttataatttaacttacagctgcttttaagcaagttctgcaagttttgcctgttttttaaccccaaacatttcatagaacttgttaagagtttcactgtaatgttccatagcaatacttcctttagcattaggattgctggagctaagtatagcagcatactcttttcctttcttcacctgatcttcattcatttcaaatgctttgcttttcagcacagtgcaaacttttcctaaggcttccttagtgtcatacttctttgggtcgatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgagaagcaatcttagatttgatagtattgagattctctgaattcccagtttcctcgacaagcctgaccctgatcaagctatcaagccttctgaaggtcatttcagtggctccaatcctgtttgaagttttctttatggtaattttaccaaaagtaaaatcactttgcttaataaccttcattatactctgacgattctttaggaacgtcagacacgaaataatgctcatcttcttgatctggtcaaggttttccagacaaaaagtcttgaagttgaatgctaccagattctgatcttcctcaaattcaaggtctttgccttgtgtcaacaaagcaacaatgttttccttagtgagcttaaccttagacatgatgatcacagaagttattatatgctttgaccgtatgtaattcaaggtgcaaaagtacaactctgtattccgcagtcgtttcttagggttttaatgtgatgatttgtaagactgagtgctaaggtttgaataaaatttgacacaattgctct

SEQ ID NO: 299 - DNA, 2991 bp, Tomato spotted wilt virus
agagcaattgtgtcagaattttattcttaatcaaacctcacttagaaaatcacaaaactgtaataagaacacagtaccaataaccataatgtcttcaagtgtttatgagtcgatcattcagacaaaagcttcagtctggggatcaactgcatctggtaaagcagttgtggattcttactggattcatgaacttgatactggttccccactagttcaaacccagctgtattctgatccaagaagcaaaagcagctttggctatactgcaaaggtagggaatcttccctgtgaagaagaagagattctttctcagcatgtgtatatccctatttttgatgatattgattttagcatcaatattgatgactctgttctggcactatctgtttgctcaaatacagtcaatactaacggagtgaaacatcaaggtcatttgaaagttttgtctcctgctcagctccactctattggatctaccatgaacagatctgatattacagaccgattccagctccaagaaaaagacataattcccaatgacagatacattgaagctgcaaacaaaggctctttgtcttgtgttaaagagcatacctataaggtcgagatgtgctacaatcaagctttgggcaaagtgaatgttctatcccctaacagaaatgtccatgaatggctgtacagtttcaagccaaatttcaatcaagttgaaagcaacaacagaactgtgaattctcttgcagtgaaatctctgcttatgtcagcagaaaacaacatcgtgcctaactctcaggcttttgttaaagcttccactgattctcatttcaagctgagcctctggctaagagttccaaaggttttgaagcagatttccattcagaaattgttcaaagttgcaggagatgaaacaaacaaaacattttatttatctattgcttgcattccaaaccacaacagtgttgagacagctttaaacatttctgttatttgcaagcatcagctcccaatccgtaaatgtagaactccttttgaattatcaatgatgttttccgatttaaaggagccttacaacattgttcatgatccttcatatcctcagaggattgttcatgctctgcttgaaactcacacatcttttgcacaagttctttgcaacaacttgcaagaagatgtgatcatctacactttgaacaactatgagctaactccaggaaagttagatctaggtgaaagaaccttaaattacagtgaagatatctgcaaaaggaaatatttcctttcaaaaacacttgaatgtcttccatctaacacacaaactatgtcttacttagacagcatccaaatcccttcctggaaaatagactttgccaggggagaaattaaaatttctccacaatctgtttcagttgcgacatctttgttaaagcttgatttaagcaagatcaaaaagaaagaatctaagatttcggaagcatatgcttcaggatcaaaataatcttgccgtgtccagctttttctaattatgttatggttgtgtctttctttacttataattatttttctggtttgtcatttcttttggaatttctcctgtttaataggaactataaaacaaaaataaaataaaataaaaaataaaaatcaaaatgaaaccgaaatcaaaaaatgaaacaaaaatcaaaaaataaaaaataaaataaaaacaacaaaaaaattaaaaaacaaaaaaccaaaaaagatcccgaaaggggcaattttggccaaatttggggtttgttttgtttttgttttttgttttttgttttttattttttattttttatttttattttattttatttattttattttatttttatttttattttttatttttattttttattttattttatgtttttgttgtttttgttattttgtttatttattaagcacaacacacagaaagcaaactttaattaaacacacttattttaaatttaacacactaagcaagcacaagcaataaagataaagaaagctttatatatttataggttcttttataatttaacttacagctgcttttaagcaagttctgcaagttttgcctgttttttaaccccgaacatttcataaaacttgttaagagtttcactgtaatgttccatagcaacacttcctttagcattaggattgctggagctaagtatagcagcatactctttccctttcttcacctgatcttcattcatttcaaatgctttgcttttcagcacagtgcaaacttttcctaaggcttcctttgtgtcatacttctttggatcgatcccgagatctttgtattttgcatcctgatatatagccaagacaacactgatcatttcaaagctatcaactgaagcaataagaggtaagctacctcccagcattatggcaagcctcacagactttgcatcatcaagaggtaatccataggcttgaatcaaagggtgagaagcaatcttagatttgatagtattgagattctcagaattcccagtttcctcgacaagcctgaccctgattaagctatcaagccttctgaaggtcatgtcagtggctccaatcctgtctgaagttttctttatggtaattttaccaaaagtaaaatcactttgcttaataaccttcattatactctgacgattcttcagaaatgtcagacatgaaataatgctcatcttcttgatctggtcaaggttttccagacaaaaagtcttgaagttgaatgctaccagattctgattttcctcaaattcaaggtctttgccttgtgtcaacaaagcaacaatgctttccttagtgagcttaaccttagacatgatgatcgtagaagttgttatatgctttgaccgtatttaactcgaggtgcaaaagtacaactctgtattccgcagtcgtttcttagggttttaatgtgatgattagtaagactgagggttaaggtttgaataaaattgacacgattgctct

SEQ ID NO: 300 - DNA, 3017 bp, Tomato spotted wilt virus
agagcaattgtgtcataattttattcttaatcaaacctcacttagaaaatcacaaaactgtaataagaacacagtaccaatagccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcactatctgtttgctcaaatacagtcaatgctaacggagtgaaacatcaaggtcatttgaaggttttgtctcctgctcagctccattctattggatctatcatgagcagatctgatattacagaccgattccagctccaagaaaaagacataattcccaatgtcagatacattgaagctgcaaacaaaggctctttgtcttgtgtcaaagagcatacctataagatcgaaatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggtcttgaagcagatttccattcagaaattgttcaaggttgcaggagatgagacaaataaaacattttatttatctatagcctgcattacaaaccataacagtgttgagacagctttaaacattactgttatttgcaagcatcagctcccaattcgtaaatgcaaagctcctttcgaattatcaatgatgttttctgatttaaaggagccttacaacattgttcatgatccttcatatccccaaaggattgttcatgctctgcttgaaactcacacatcttttgcacaagttcttagcaacaatttgcaagaagatgtgatcatctacaccttgaacaaccatgagctaactcctggaaagttagatataggtgaaagaaccttgaattacagtgaagatgcctacaaaaggaaatatttcctttcaaaaacacttgaatgtcttccaactaacacacaaactatgtcttatttagacagcatccaaatcccttcctggaagatagactttgccaggggagaaattaaaatttctccgcagtccatttcagttgaaaaatctttgttaaagcttgatttaagcgggatcaaaaagaaagaatctaaggttaaggaagcatatgcttcaggatcaaaatgatcttgctgtgtccagccttttctaattatgttatgtttattttctttctttatttataattatttctctatttgtcatttctttcaaattccttctgtctagtagaaaccataaaaacaaaaatgaaaataaaataaatcaaaataaaataaaatcaaaaatgaaataaaaaacaaaaaataaaaacaaaaaaccaaaaaagatcccgaaaggacaattttggccaaatttgggtttgtttttgttgtttttgttttttgttttttgtttttattttattttattttatttatttttattttatttttgtttttatcttatgtttttttgttgtttttgttattttgttatttattaagcacaacacacagaaagcaaactttattttatcttatttatttttattttatttttgttcttatcttatgttttttgttgtttttgttattttattatttattaagcacaacacacagaaagcaaactttaattaaacacacttatttaaaatttaacacactaagcaagcacaagcaataaagataaagaaagctttatatatttataggctttttataatttaacttacagctgcttttaagcaagttctgtgagttttgcctgttttttaaccccaaacatttcatagaacttgttaagagtttcactgtaatgttccatagcaacacttcctttagcattgggattgctggaactaagtatagcagcatactctttccccttcttcacctgatcttcagtcatttcaaatgctttgcttttcagcacagtgcaaactttccctaaggcttccctggtgtcatacttctttgggtcgatcccgaggtccttgtattttgcatcctgatatatagccaagacaacactgatcatctcaaagctatcaactgaagcaataagaggtaagccacctcctagcattatggcaagcctcacagactttgcatcatcaagagttaatccataggcttgaatcaaagggtgggaagcaatcttagatttgatagtattgagattctcagaattcccagtttcctcaacaagcctgaccctaatcaagctatcaagccttctgaaggtcatgtcagtggctccaatcctatctgaagttttctttatggtaattttaccaaaagtaaagtcactttgcttgataactttcattatgctctgacgattcttcaggaatgtcagacatgaaataatgctcatctttttgatctggtcaaggtttcccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaattcaaggtgcaaaagtgcaactctgtatcccgcagtcgtttcttagggttttaatgtgatgatttgtaagactgagtgttaaggtttgaataaaattgacacaattgctct

SEQ ID NO: 301 - DNA, 2955 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttggctatactgcaaaggtagggaatcttccctgtgaagaagaagagattctttctcagcatgtgtatatccctatttttgatgatattgattttagcattaatattgatgactctgttctggcactatctgtttgctcaaatacagtcaatactaacggagtgaaacatcaaggtcatttgaaagttttgtctcctgctcagctccactctattggatctaccatgaacagatctgatattacagaccgattccagcttcaagaaaaagacataattcccaatgacagatacatcgaagctgcaaacaaaggctctttgtcttgtgtcaaagagcatacctataagatcgagatgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctctgctcatgtcagcagaaaacaacatcatgcctaaccctcaggcttttgtcaaagcttccactgattctcatttcaaactgagcctctggctaagggtcccaaaggttctgaagcaggtctctattcagaagttgttcaaagttgcaggagacgaaacaaataaaacattttatttatctattgcttgcattccaaaccataacagtgttgagacagctttaaacatttctgttatttgcaagcatcagctcccaattcgtaaatgtaaaattccttttgaattatcaatgatgttttctgatttaaaggagccttacaacattgttcatgatccttcgtatcctcagaggattgttcatgctctgcttgaaactcacacatcttttgcacaagttctttgcaacaacttacaagaagatgtgatcatctacactttgaacaactatgtgctaactcctggaaagttagatttaggtgaaagaaccttaaattacagtgaagatatctgcaaaaggaaatatttcctttcaaaaacacttgaatgtcttccatctaacacacgaactatgtcttacttggacagcatccaaatcccttcctggaagatagactttgccaggggagaaattaagatttctccacaacctgtttcagttgcaaaatctttgttaaagcttgatttaagcaggatcgaaaagaaagaatctaagattccagaaacatatgcttcaggatcaaaataatcttgctgtgtccggtttttctaattatgttatgtttattttcttttttacttataattatttctctgttttgtcatttcttttaagttcctcctgtttaatagaaaccataaaacaaaaataaaataaaaataaaatcaaaaatgaaacaaaaatcaaaaaatgaaacaaaaataaaaaataaaaaatgaaataaaaacaacaaaaaaattaaaaaacagaaacccaaaaaagatcccgaaagggacaatcttggccaaatttgggttttgttttgtttttgttttttgttttttgtttttatttttattttatttatttattttattttatttttattttttattttgttttttattttatgttttttgttgtttttgttattttgtttatttattaagcataacacacagaaagcaaactttaattaaacacacttattttaaatttaacacactaagcaagcacaagcaataaagataaaaaaagctttatatatttgtagacttttccataatttaacttacagctgattttaagcaagttctgcgagttttgcctgttttttaaccccgaacatttcatagaacttgttaagagtttcactgtaatgttccatagcaatacttcctttagcattaggattgctggagctgagtatagcagcatactcttttcctttcttcacctgatcttcattcatttcaaatgctttgcttttcagcacagtgcaaacttttcctaaggcttctctggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacaaagcaacaatgttttccttagtgagcttaaccttagacatgatgattgtagaagttgttatatgctttgaccgtatgtaattcaaggtgcgaaagtgcaactctgtattccgcagtcgtttcttagggttttaatgtgatgatttgtaagactgagtgttaaggtttgaataaaattgacacaattgctct

SEQ ID NO: 302 - DNA, 2958 bp, Tomato spotted wilt virus
agagcaatcgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttggctatactgcaaaggtagggaatcttccctgtgaagaagaagagattctctctcagcatgtgtatatccctatttttgatgatattgattttagcatcaatattgatgactctgttctggcactatctgtttgctcaaatacagtcaatactaacggagtgaaacatcaaggtcatttgaaagttttgtctcctgatcagctccactctattggatctaccatgaacagatctgatattaaagaccgattccagcttcaagaaaaagacataattcccaatgacagatacatcgaagctgcgaacaaaggctctttgtcttgtgtcaaagagcatacctataagatcgaaacgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctctgctcatgtcagcagaaaacaacatcatgcctaactctcaggcttttgtcaaagcttccactgattctcatttcaaactgagcctctggctaaggtttccaaaggttctgaagcaggtctccattcagaaattgttcaaggttgcaggagatgaaacaaataaaacattttatttatctattgcttgcattccgaaccataacagtgttgagacagctttaaacatttctgttatttgcaagcatcagctcccaattcgtaaatgtaaagctccttttgaattatcaatgatgttttctgatttgaaggagccttacaacattgttcatgatccttcatatcctcagaggattgttcatgctctgcttgaaactcacacatcttttgcacaagttctttgcaacaacttacaagaagatgtgatcatctacactttgaacaactatgagctaactccaggaaagttagatttaggtgaaagaaccttaaattacagtgaagatatctgcaaaaggaaatatttcctttcaaagacacttgaatgtcttccatctaacacacaaactatgtcttacttggacagcatccaaatcccttcctggaagatagactttgccaggggagaaattaagatttctccacaacctgtttcagttgcaaaatctttgttaaagcttgatttaagcgggatcaaaaagaaagaatctaagatttcggacgattatgcttcaggatcaaaataatcttgctgtgtccggtttttctaattatgttatgtttattttctttctttacttataattatttctctgttttgtcatttcttttaagttcctcttgtttaatagaaaccataaaacaaaaaataaaataggaataaaaatcaaaaaatgaaacaaaaatcaaaaaatgaaacaaaaataaaaaatgaaataaaaacaacaaaaaaattaaaaaacaaaaacccaaaaaagatcccgaaagggacaattttggccaaatttgggttttgttttgtttttgtttttgttttttgtttttatttttattttatttatttattttatttattttttattttttattttttattttcgtttttattttatgttttttgttgtttttgttattttgtttgtttattaagtacaacacacagaaagcaaactttaattaaacacacttattttaaatttaacacactaagcaagcacaagcaataaagataaagaaagctttatatatttgtaggcttttccataatttaacttacaactgcttttaagcaagttctgtgagttttgcctgttttttaaccccaaacatttcatagaacttgttaagagtttcactgtaatgttccatagcaatacttcctttagcattaggattgctggagctgagtatagcagcatactcctttcctttcttcacctgatcttcattcatttcaaatgctttgcttttcagcacagtgcaaactcttcctaaggcttccttggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcgtcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccgaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgtatgtaactcaaggtgcgaaagtgcaactctgtattccgcagtcgtttcttagggttttaatgtgatgatttgtaagactgagtgttaaggtttgaataaaattgacacgattgctct

SEQ ID NO: 303 - DNA, 3364 bp, Tomato spotted wilt virus
agagcaatcgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggcaaagctgttgtagattcttactggattcatgaactcggtactggttctctactagttcaaacccagctgtattctgattcaagaagcaaaagtagctttggctatactgcaaaggtagggaatcttccctgtgaagaagaagagattctctctcagcatgtgtatatccctatttttgatgatattgattttagcatcaatattgatgactctgttctggcactatctgtttgctcaaatacagtcaatactaacggagtgaaacatcaaggtcatttgaaagttttgtctcctgatcagctccactctattggatctaccatgaacagatctgatattaaagaccgattccagcttcaagaaaaagacataattcccaatgacagatacatcgaggctgcaaacaaaggctctttgtcttgtgtcaaagagcatacctataagatcgaaacgtgctataatcaagctttgggcaaagtgaatgttttatcccctaacaggaatgtccatgaatggctgtacagtttcaagccaagtttcaatcaagttgaaagcaacaacagaactgtaaattctcttgcagtgagatctctgctcacgtcagcagaaaacaacatcatgcctaactctcaggcttttgtcaaagcttccactgattctcatttcaaactgagcctctggctaagggttccaaaggttctgaggcaggtctccattcagaaattgttcaaggttgcaggagatgaaacaaataaaacattttatttatctattgtttgcattccaaaccataacagtgttgagacagctttaaacatttctgttatttgcaagcatcagctcccaattcgtaaatgtaaagctccttctgaattatcaatggtgttttctgatttgaaggagccttataacattgttcatgatccttcatatcctcagaggattgttcatgctctgcttgaaactcacacatcttttgcacaagttctttgcaacaacttacaagaagatgtgatcatctacactttgaacaactatgagctaactccaggaaagttagatttaggtgaaagaaccttaaattacagtgaagatatctgcaaaaggaaatatttcctttcaaaaacacttgaatgtcttccatctaacacacaaactatgtcttacttggacagcatccaaatcccttcctggaagatagactttgccaggggaggaattaagatttctccacaacctgtttcagttgcaaaatctttgttaaagcttgatttaagcgggatcaaaaagaaaggatctaagatttcggatggttatgcttcaggatcaaaataatcttgctgtgtccggtttttctaattatgttatgtttattttctttctttacttataatcgcttctctgtttgtcatttcttttaagttcctcttgtttaatagaaaccataaaacaaaatataaaataaaaataaaatcaaaaatgaaacaaaaatcaaaaaatgaaacaaaaataaaaaatgaaataaaaacaacaaaaaaattaaaaaacaaaaaaccaaaaaagatcccgaaagggacaattttggccaaatttgggttttgttttgtttttgtttttgttttttgtttttatttttattttatttatttattttatttattttttattttttatattttttattttttattttttattttttattttttattttttattttttattttttatttttcattttttattttttatttttttattttttattttttatttttattttttattttttattttatattttttattttttatttttattttttattttttattttttattttttattttttatttcttattttttactttttattttttattttttattttttattttttattttttattttttattttttattttttatttttttattttttattttttattttttattttttattttttattttttatttttttattttttattttttattttttattttttattttttattttttatttttgtttttatcttatgttctttgttgtttctgttattttgtttgtttattaagcacaacacacagaaagcaaactttaattaaacacacttattttaaatttattaagcacaacacacagaaagcaaactttaattaaacacacttattttaaatttaacacactaagcaagcacaagcaataaagataaagaaagctttatatatttgtagacttttccataatttaacttacaactgcttttaagcaagttctgtgagttttgcctgttttttaaccccaaacatttcatagaacttgttaagagtttcactgtaatgtcccatagcaatacttcctttagcattaggattgctggagctgagtatagcagcatactcttttcctttcttcacctgatcttcattcatttcaaatgctttgcttttcagcacagtgcaaacttttcctaaggcttccttggtgtcatacttctttgggtcaatcccgaggtcttttgtatttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcatgctatcaagccttctgaaggtcatgtcagtggctccaatcctgtctgaagttttctttatggtaattttaccaaaagtaaaatcactttgtttaataaccttcattatactctgacgattcttcgggaatgtcagacatgaaataacgctcatcttcttgatctggtcgaggttttctagacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgatatgtaattcaaggtgcgaaagtgcaactctgtattccgcagtcgtttcttagggttttaatgtgatgatttgtaagactgagtgttaaagtttgaataaaattgacacgattgctct

SEQ ID NO: 304 - DNA, 2948 bp, Tomato spotted wilt virus
agagcaatcgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttgactatactgcaagggtagggaatcttccctgtgaagaagaagagattctttctcagcatgtgtatatccctatttttgatgatattgattttagcatcaatattgatgactctgttctggcactatctgtttgctcaaatacagtcaatactaacggagtgtttcatcaaggtcatttgaaagttttgtctcctgatcagctccactctatcggatctaccatgaacagatctgatattaaagaccgattccagcttcaagaaaaagacataattcccaatgacagatacatcgaagctgcaaacaaaggctctttgtcttgtgtcaaagagcatacctataagatcgaaacgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctctgctcatgtcagcaggaaacaacatcatgcctaactctcaggcttttgtcaaagcttccactgattctcatttcaaactgagcctctggctaagggttccaaaggttctgaagcaggtctacattcagaaattgttcaaggttgcaggagatgaaacaaataaaacattttatttatctattgtttgcattccaaaccataacagtgttgagacagctttaaacatttctgttatttgcaagcatcagcttccaattcgtaaatgtaaagctccttttgaattatcaatgatgttttctgatttgaaggagccttacaacattgttcatgatccttcatatcctcagaggattgttcatgctctgcttgaaactcacacatcttttgcacaagttctttgcaacaacttacaagaagatgtgatcatctacactttgaacaactatgagctaactccaggaaagttagatttaggtgaaagaaccttaaattacagtgaagatatctgcaaaaggaaatatttcctttcaaaaacacttgaatgtcttccatctaacacacaaactatgtcttacttagacagcatccaaatcccttcctggaagatagactttgccaggggagaaattgagatttctccacaacctgtttcagttgcaaaatctttgttaaaacttgatttaagcgggatcaaaaagaaagaatctaagatttcggaaacatatgcttcaggatcaaaataatcttgctgtgtccggtttttctaattatgttatgtttatcttctttctttacttataattatttctctgttttgtcatttcttttaagttcctcttgtttaatagaaaccataaaacaaaaaataaaataaaaataaaaatcaaaaaatgaaacaaaaatcaaaatgaaacaaaaataaaaaatgaaataaaaacaacaaaaaaattaaaaaacaaaaacccaaaaaagatcccgaaagggacaattttggccaaatttggggtttgttttgtttttgtttttgttttttgtttttatttttattttatttattttattttttattttttattttttatttttgtttttattttatgttttttgttgtttttgttattttgtttgtttattaagcacaacacacagaaagcaaactttaattaaacacacttattttaaatttaacacactaagcaagcacaagcaataaagataaagaaagctttatatatttgtagacttttccatagtttaacttacaactgcttttaagcaagttctgcgagttttgcctgttttttaaccccaaacatttcatagaacttgttaagagtttcactgtaatgttccatagcaatacttcctttagcattaggattgctggagctgagtatagcagcatactcttttcctttcttcacctgatcttcattcatttcaaatgctttgcttttcagcacagtgcaaacttttcctaaggcttccctggtgtcatacttctttgggtcaatcccgaggtctttgtattttgcatcctgatatatagccaagacaacactgatcatctcaaagctatcaactgaagcaataagaggtaagctacctcccagcattatggcaagtctcacagactttgcatcatcaagaggtaatccataggcttggatcaaagggtgggaagcaatcttagatttgatagtattgagattctcagaattcccagtttcctctacaagcctgaccctgatcaagctatcaagccttctggaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggtcttccaaacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgtatgtaattcgaggtgcgaaagtgcaactctgtattccgcagtcgtttcttagggttttaatgtgatgatttgtaagactgagtgttaaggtttgaataaaattgacacgattgctct

SEQ ID NO: 305 - DNA, 3006 bp, Tomato spotted wilt virus
agagagcaatcgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcctactggattcatgaacttggcactggttctccactagttcaaacccagctgtattctgattcaagaagcaaaagtagctttggctatactgcaaaggtagggaatcttccctgtgaagaagaagagattctttcccagcatgtgtatatccctatttttgatgatattgattttagcattaatattgatgactctgttctggcactatctgtttgctcaaatacagtcaatactaacggagtgaaacatcaaggtcatttgaaagttttgtctcctgctcagctccactctattggatctaccatgaacagatctgatattacagaccgattccagcttcaagaaaaagacataattcccaatgacagatacatcgaagctgcaaacaaaggctctttgtcttgtgtcaaagagcatacctataagatcgaaacgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctcttctcatgtcagcagaaaacaacatcatgcctaactctcaggcttttgtcaaagcttccactgattctcatttcaaactgagcctctggctaagggtcccaaaggttctgaagcaggtctctattcagaaattgttcaaagttgcaggagacgaaacaaaaacattttatttatctattgcttgcattccaaaccataacagtgttgagacagctttaaacgtttctgttatttgcaagcatcagctcccaattcgtaaatgtaaagctccttttgaattatcaatggtgttttctgatttaaaggagccttacaacattgttcatgatccttcatatcctcagaggattgttcatgctctgcttgaaactcacacatcttttgcacaagttctttgcaacaacttacaagaagatgtgatcatctacactttgaacaactatgagctaactcctggaaagttagatttaggcgaaagaaccttaaattacagtgaagatatctgcaaaaggaaatatttcctttcaaaaacacttgaatgtcttccatctaacacacaaaccatgtcttacttggacagcatccaaatcccttcctggaagatagactttgccaggggagaaattaagatttctccacaacctgtttcagttgcaaaatctttgttaaagcttgatttaagcgggatcaaaaagaatggatctaagatttcggaaacacatgcttcaggatcaaaataatcttgctgtgtccggtttttctaattatgttatgtttattttctttctttacttataattacttctctgttttgtcatttcttttaagttcctcttgtttaatagaaacaataaaacaaaaaataaaataaaaataaaaatcaaaaatgaaacaaaaatcaaaaaaatgaaacaaaaataaaaaatgaaataaaaacaacaaaaaaattaaaaaacaaaaacctaaaaaagatcccgaaagggacaattttggccaaatttgggttttgttttgtttttgtttttgttttttgtttttatttttattttatttatttattttatttattttttattttttattcgcagtttttattttatgttttttgatgtttttgttattttgtttgtttattaagcacaacacacagaaagcaaactttaattaaacacacttattttaaatttattaagcacaacacacagaaagcaaactttaattaaacacacttattttaaatttaacacactaagcaagcacaagcaataaagataaagaaagctttatatatttgtagacttttccataatttaacttacaactgcttttaagcaagttctgcgagttttgcctgttttttaaccccaaacatttcatagaacttgttaagagtttcactgtaatgttccatagcaatacttcctttagcattaggattgctggagctgagtatagcagcatactcttttcctttcttcacctgatcttcattcatttcaaatgctttgcttttcagcacagtgcaaacttttcctaaggcttccttggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaacccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataacctttattatactctgacgattcttcaggaatgtcagacatgaaataacgctcatcttcttgatctggtcaaggttttctagacaaaaagtcttgaagttgaatgctaccagattctgatcttcctcgaactcaaggtctttgccttgtgtcaacaaagcaacaatgctttccttagtgagcttaaccttagacatgatgattatagaagttgttatatgctttgaccgtatgtaattcaaggtgcgaaagtgcaactctgtattccgcagtcgtttcttagggttttaatgtgatgatttgtaagactgagtgttaaggtttgaataaaattgacacgattgctct

SEQ ID NO: 306 - DNA, 2927 bp, Tomato spotted wilt virus
agagcaattgtgtcataattttattcataatcaaacctcacttagaaaatcacaatactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttagctatactgcaaaagtaggagatcttccttgtgaagaagaagagattctctctcagcatgtgtatatccccatttttgatgatattgattttagcatcaatattgatgactctgttctggcactatctgtttgctcaaatacagtcaatgctaatggagtgaaacatcaaggtcatttgaaggttttgtctcctgctcagctccactctattggatctatcatgaacagatctgatattacagaccgattccagctccaagaaaaagacataattcccaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctactcatgtcagcagaaaacaacatcatgcccaactctcaagcttttgtcaaagcttccactgattctcatttcaagctgagcctctggctaagggttccaaaggttttgaagcagatttccattcagaaattgttcaaggttgcaggagatgaaacaaataaaacattttatttatctattgcctgcattccaaaccataacagtgttgagacagctttaaacattactgttatttgcaagcatcagctcccaattcgtaaatgtgaagctccttttgaattatcaatgatgttttctgatttaaaggagccttacaacattgttcatgatccttcatatccccaaaggattgtccatgctctgcttgaaactcacacatcttttgcacaagttctttgcaacaacttgcaagaagatgtgatcatttacactttgaacaaccatgagctaactcctagaaagttagatttaggtgaaacaaccttgaattacggtgaagatgcctacaaaaggaaatatttcctttcaaaaacacttgaatgtcttccatctaacacacaaactatttcttatttagacagcatccaaatcccctcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaatgatcttgctgtgtccatcgttttctaattatgtcatgtttatttctttctttacttataattatttctctgtttgtcatttctttcaaatccctcctgtctagtagaaaccataaaacaaaaataaaaaataaaaaataaataaaatcaaaataaaataaaaatcaaaaaatgaaataaaaacaacaaaaaaattaaaaacaaaaaaccaaaaaagatcccgaaagggacaattttggccaaatttgggttttgtttttgttttttgttttttgttttttgtttttatttttattttatttatttttatttattttattttatttttgtttttattttatgtttttgttgtttttgttattttgttatttattaagcacaacacacagaaagcaaactttaattaaacacacttattaaaatttaacacactaagcaagcacaagcaataaagataaagaaagctttatatatttataggcttttttataatttaacttacagctgcttttaagcaagttctgtgagttttgcctgttttttaaccccaaacatttcatagaacttgttaagagtttcgctgtaatgttccatagcaatacttcctttagcattaggattgctggagctaagtatagcagcatactctttccccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattctaccaaaagtaaaatcactttgcttaataaccttcattatgctctgacgattcttcaggaatgtcagacatgaaataatgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgcaactcaaggtgcaaaagtgcaactctgtatcccgcagtcgtttcttagggttttaatgtgatgatttgtaagactgagtgttaaggtttgaataaaattgacacaattgctct

SEQ ID NO: 307 - DNA, 2926 bp, Tomato spotted wilt virus
agagcaattgtgtcataattttattcataatcaaacctcacttagaaaatcacaatactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttagctatactgcaaaagtaggagatcttccttgtgaagaagaagagattctctctcagcatgtgtatatccccatttttgatgatattgattttagcatcaatattgatgactctgttctggcactatctgtttgctcaaatacagtcaatgctaatggagtgaaacatcaaggtcatttgaaggttttgtctcctgctcagctccactctattggatctatcatgaacagatctgatattacagaccgattccagctccaagaaaaagacataattcccaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctactcatgtcagcagaaaacaacatcatgcctaactctcaagcttttgtcaaagcttccactgattctcatttcaagctgagcctctggctaagggttccaaaggttttgaagcagatttccattcagaaattgttcaaggttgcaggagatgaaacaaataaaacattttatttatctattgcctgcattccaaaccataacagtgttgagacagctttaaacattactgttatttgcaagcatcagctcccaattcgtaaatgtgaagctccttttgaattatcaatgatgttttctgatttaaaggagccttacaacattgttcatgatccttcatatccccaaaggattgtccatgctctgcttgaaactcacacatcttttgcacaagttctttgcaacaacttgcaagaagatgtgatcatttacactttgaacaaccatgagctaactcctagaaagttagatttaggtgaaacaaccttgaattacggtgaagatgcctacaaaaggaaatatttcctttcaaaaacacttgaatgtcttccatctaacacacaaactatttcttatttagacagcatccaaatcccctcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaatgatcttgctgtgtccatcgttttctaattatgtcatgtttatttctttctttacttacaattatttctctgtttgtcatttctttcaaattcctcctgtctagtagaaaccataaaacaaaaataaaaaataaaaaataaataaaatcaaaataaaataaaaatcaaaaaatgaaataaaaacaacaaaaaaattaaaaacaaaaaaccaaaaaagatcccgaaagggacaattttggccaaatttgggttttgtttttgttttttgttttttgttttttgttttatttttattttatttatttttatttattttattttatttttgtttttattttatgtttttgttgtttttgttattttgttatttattaagcacaacacacagaaagcaaactttaattaaacacacttattaaaatttaacacactaagcaagcacaagcaataaagataaagaaagctttatatatttataggcttttttataatttaacttacagctgcttttaagcaagttctgtgagttttgcctgttttttaaccccaaacatttcatagaacttgttaagagtttcgctgtaatgttccatagcaatacttcctttagcattaggattgctggagctaagtatagcagcatactctttccccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattctaccaaaagtaaaatcactttgcttaataaccttcattatgctctgacgattcttcaggaatgtcagacatgaaataatgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgcaactcaaggtgcaaaagtgcaactctgtatcccgcagtcgtttcttagggttttaatgtgatgatttgtaagactgagtgttaaggtttgaataaaattgacacaattgctct

SEQ ID NO: 308 - DNA, 2921 bp, Tomato spotted wilt virus
agagcaattgtgtcataattttattcataatcaaacctcacttagaaaatcacaatactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttagctatactgcaaaagtaggagatcttccttgtgaagaagaagagattctctctcagcatgtgtatatccccatttttgatgatattgattttagcatcaatattgatgactctgttctggcactatctgtttgctcaaatacagtcaatgctaatggagtgaaacatcaaggtcatttgaaggttttgtctcctgctcaactccactctattggatctatcatgaacagatctgatattacagaccgattccagctccaagaaaaagacataattcccaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagtcgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaggttgcaggagatgaaacaaataaaacattttatttatctattgcctgcattccaaaccataacagtgttgagacagctttaaacattactgttatttgcaagcatcagctcccaattcgtaaatgtgaagctccttttgaattctcaatgatgttttctgatttaaaggagccttacaacattgttcatgatccttcatatccccaaaggattgtccatgctctgcttgaaactcacacatcttttgcacaagttctttgcaacaacttgcaagaagatgtgatcatttacactttgaacaaccatgagctaactcctagaaagttagatttaggtgaaataaccttgaattacggtgaagatgcctacaaaaggaaatatttcctttcaaaaacacttgaatgtcttccatccaacacacaaactatgtcttatttagacagcatccaaattccctcctggaagatagactttgccagaggagaaattaaaatttctccgcaatctatttcagttgcaaaatctttgttaaagcttgatttaagcaggatcaaaaagaaagaatctaagattaaggaggcatatgcttcaggatcaaaatgatcttgctgtgtccatcgttttctaattatgttatgtttatttctttctttacttataattatttctctgtttgtcatttctttcaaattcctcctgtctagtagaaaccataaaacaaaaataaaaaataaaataaaatcaaaataaaataaaaatcaaaaaatgaaataaaaacaacaaaaaaattaaaaacaaaaaaccaaaaaagatcccgaaagggacaattttggccaaatttgggttttgtttttgttttttgttttttgttttttgtttttatttttattttatttatttttatttattttattttatttttgttttattttatgttttttgttgtttttgttattttgttatttattaagcacaacacacagaaagcaaactttaattaaacacacttattaaaatttaacacactaagcaagcacaagcaataaagataaagaaagctttatatatttataggcttttttataatttaacttacagctgcttttaagcaagttctgtgagttttgcctgttttttaaccccaaacatttcatagaacttgttaagagtttcgctgtaatgttccatagcaatacttcctttagcattaggattgctagagctaagtatagcagcatactctttccccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtgttgagattctcagaattcccagtttcctcaacaagcctgaccctgatcaagctatcaagccttctgaaggtcatgtcagtggctccaatcctgtctgaagttttctttatggtaattctaccaaaagtaaaatcactttgcttaataaccttcattatgctctgacgattcttcaggaatgtcagacatgaaataatgctcatctttttgatctggtcaaggttttccagacaaaaagtcttgaagttgaatgctaccagattctgatcttcctcaaactcaaggtctttgccttgtgtcaacaaagcaacaatgttttccttagtgagcttaaccttagacatgatgatcgtagaagttgttatatgctttgaccgtatgcaactcaaggtgcaaaagtgcaactctgtatcccgcagtcgtttcttagggttttaatgtgatgatttgtaagactgagtgttaaggtttgaataaaattgacacaattgctct

SEQ ID NO: 309 - DNA, 2921 bp, Tomato spotted wilt virus
agagcaattgtgtcataattttattcataatcaaacctcacttagaaaatcacaatactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttagctatactgcaaaagtaggagatcttccttgtgaagaagaagagattctctctcagcatgtgtatatccccatttttgatgatattgattttagcatcaatattgatgactctgttctggcactatctgtttgctcaaatacagtcaatgctaatggagtgaaacatcaaggtcatttgaaggttttgtctcctgctcagctccactctattggatctatcatgaacagatctgatattacagaccgattccagctccaagaaaaagacataattcccaatgacagatacattgaagccgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaggttgcaggagatgaaacaaataaaacattttatttatctattgcctgcattccaaaccataacagtgttgagacagctttaaacattactgttatttgcaagcatcagctcccaatccgtaaatgtgaagctccttttgaattatcaatgatgttttctgatttaaaggagccttacaacattgttcatgatccttcatatcctcaaaggattgtccatgctctgcttgaaactcacacatcttttgcacaagttctttgcaacaacttgcaagaagatgtgatcatttacactttgaacaaccatgagctaactcctagaaagttagatttaggtgaaataaccttgaattacggtgaagatgcctacaaaaggaaatatttcctttcaaaaacacttgactgtcttccatctaacacacaaactatgtcttatttagacagcatccaaatcccctcctggaagatagactttgccaggggagaaattaaaatttctccgcaatctatttcagttgcaaaatctttgttacagcttgatttaagcgggatcaaaaagaaagaatctaagattaaggaagcatatgcttcaggatcaaaatgatcttgctgtgtccatcattttctaattatgttatgtttatttctttctctacttataattatttctctgtttgtcatttctttcaaattcctcctgtctagtagaaaccataaaacaaaaataaaaaataaaataaaatcaaaataaaataaaaatcaaaaaatgaaataaaaacaacaaaaaaattaaaaacaaaaaaccaaaaaagatcccgaaagggacaattttggccaaatttgggttttgtttttgttttttgttttttgttttttgtttttatttttattttatttatttttatttattttatttatttttgtttttattttatgttttttgttgtttttgttattttgttatttattaagcacaacacacaaaaagcaaactttaattaaacacacttattaaaatttaacacactaagcaagcacaagcaataaagataaagaaagctttatatatttataggcttttttataatttaacttacagctgcttttaagcaagttctgtgagttttgcctgttttttaaccccaaacatttcatagaacttgttaagagtttcgctgtaatgttccatagcaatacttcctttagcattaggattgctggagctaagtatagcagcatactcttttcccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattctaccaaaagtaaaatcactttgcttaataaccttcattatgctctgacgattcttcaggaatgtcagacatgaaataatgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgcaactcaaggtgcaaaagtgcaactctgtatcccgcagtcgtttcttagggttttaatgtgatgatttgtaagactgagtgttaaggtttgaataaaattgacacaattgctct

SEQ ID NO: 310 - DNA, 2921 bp, Tomato spotted wilt virus
agagcaattgtgtcataattttattcataatcaaacctcacttagaaaatcacaatactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttagctatactgcaaaagtaggagatcttccttgtgaagaagaagagattctctctcagcatgtgtatatccccatttttgatgatattgattttagcatcaatattgatgactctgttctggcactatctgtttgctcaaatacagtcaatgctaatggagtgaaacatcaaggtcatttgaaggttttgtctcctgctcagctccactctattggatctatcatgaacagatctgatattacagaccgattccagctccaagaaaaagacataattcccaatgacagatacattgaagccgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaggttgcaggagatgaaacaaataaaacattttatttatctattgcctgcattccaaaccataacagtgttgagacagctttaaacattactgttatttgcaagcatcagctcccaatccgtaaatgtgaagctccttttgaattatcaatgatgttttctgatttaaaggagccttacaacattgttcatgatccttcatatccccaaaggattgtccatgctctgcttgaaactcacacatcttttgcacaagttctttgcaacaacttgcaagaagatgtgatcatttacactttgaacaaccatgagctaactcctagaaagttagatttaggtgaaataaccttgaattacggtgaagatgcctacaaaaggaaatatttcctttcaaaaacacttgactgtcttccatctaacacacaaactatgtcttatttagacagcatccaaatcccctcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaatgatcttgctgtgtccatcgttttctaattatgttatgtttatttctttctttacttataattatttctctgtttgtcatttctttcaaattcctcctgtctagtagaaaccataaaacaaaaataaaaaataaaataaaatcaaaataaaataaaaatcaaaaaatgaaataaaaacaacaaaaaaattaaaaacaaaaaaccaaaaaagatcccgaaagggacaattttggccaaatttgggttttgtttttgttttttgttttttgttttttgtttttatttttattttatttatttttatttattttatttatttttgtttttattttatgttttttgttgtttttgttattttgttatttattaagcacaacacacagaaagcaaactttaattaaacacacttattaaaatttaacacactaagcaagcacaagcaataaagataaagaaagctttatatatttataggcttttttataatttaacttacagctgcttttaagcaagttctgtgagttttgcctgttttttaaccccaaacatttcatagaacttgttaagagtttcgctgtaatgttccatagcaatacttcctttagcattaggattgctggagctaagtatagcagcatactctttccccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattctaccaaaagtaaaatcactttgcttaataaccttcattatgctctgacgattcttcaggaatgtcagacatgaaataatgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgcaactcaaggtgcaaaagtgcaactctgtatcccgcagtcgtttcttagggttttaatgtgatgatttgtaagactgagtgttaaggtttgaataaaattgacacaattgctct

SEQ ID NO: 311 - DNA, 2920 bp, Tomato spotted wilt virus
agagcaattgtgtcataattttattcataatcaaacctcacttagaaaatcacaatactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttagctatactgcaaaagtaggagatcttccttgtgaagaagaagagattctctctcagcatgtgtatatccccatttttgatgatattgattttagcatcaatattgatgactctgttctggcactatctgtttgctcaaatacagtcaatgctaatggagtgaaacatcaaggtcatttgaaggttttgtctcctgctcagctccactctattggatctatcatgaacagatctgatattacagaccgattccagctccaagaaaaagacataattcccaatgacagatacattgaagccgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaggttgcaggagatgaaacaaataaaacattttatttatctattgcctgcattccaaaccataacagtgttgagacagctttaaacattactgttatttgcaagcatcagctcccaatccgtaaatgtgaagctccttttgaattatcaatgatgttttctgatttaaaggagccttacaacattgttcatgatccttcatatccccaaaggattgtccatgctctgcttgaaactcacacatcttttgcacaagttctttgcaacaacttgcaagaagatgtgatcatttacactttgaacaaccatgagctaactcctagaaagttagatttaggtgaaataaccttgaattacggtgaagatgcctacaaaaggaaatatttcctttcaaaaacacttgactgtcttccatctaacacacaaactatgtcttatttagacagcatccaaatcccctcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaatgatcttgctatgtccatcgttttctaattatgttatgtttatttctttctttacttataattatttctctgtttgtcatttctttcaaattcctcctgtctagtagaaaccataaaacaaaaataaaaaataaaataaaatcaaaataaaataaaaattaaaaaatgaaataaaaacaacaaaaaaattaaaaacaaaaaaccaaaaaagatcccgaaagggacaattttggccaaatttgggttttgtttttgttttttgttttttgttttttgtttttatttttatttatttatttttatttattttatttatttttgtttttattttatgttttttgttgtttttgttattttgttatttattaagcacaacacacagaaagcaaactttaattaaacacacttattaaaatttaacacactaagcaagcacaagcaataaagataaagaaagctttatatatttataggcttttttataatttaacttacagctgcttttaagcaagttctgtgagttttgcctgttttttaactccaaacatttcatagaacttgttaagagtttcgctgtaatgttccatagcaatacttcctttagcattaggattgctggagctaagtatagcagcatactctttccccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattctaccaaaagtaaaatcactttgcttaataaccttcattatgctctgacgattcttcaggaatgtcagacatgaaataatgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgcaactcaaggtgcaaaagtgcaactctgtatcccgcagtcgtttcttagggttttaatgtgatgatttgtaagactgagtgttaaggtttgaataaaattgacacaattgctct

SEQ ID NO: 312 - DNA, 2927 bp, Tomato spotted wilt virus
agagcaattgtgtcataattttattcataatcaaacctcacttagaaaatcacaatactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagcagctttagctatactgcaaaagtaggagatcttccttgtgaagaagaagagattctctctcagcatgtgtatatccccatttttgatgatattgattttagcatcaatattgatgactctgttctggcactatctgtttgctcaaatacagtcaatgctaatggagtgaaacatcaaggtcatttgaaggttttgtctcctgctcagctccactctattggatctatcatgaacagatctgacattacagaccgattccagctccaagaaaaagacataattcccaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctactcatgtcagcagaaaacaacatcatgcctaactctcaagcttttgtcaaagcttccactgattctcatttcaagctgagcctctggctaagggttccaaaagttttgaagcaaatttccattcagaaattgttcaaggttgcaggagatgaaacaaataaaacattttatttatctattgcctgcattccaaaccataacagtgttgagacagctttaaacattactgttatttgcaagcatcagctcccaattcgtaaatgtggagctccttttgaattatcaatgatgttttctgatttaaaggagccttacaacattgttcatgatccttcatatccccaaaggattgtccatgctctgcttgaaactcacacatcttttgcacaagttctttgcaacaacttgcaagaagatgtgatcatttacactttgaacaaccatgagctaactcctagaaagttagatttaggtgaaacaaccttgaattacggtgaagatgcctacaaaaggaaatatttcctttcaaaaacacttgaatgtcttccatctaacacacaaactatttcttatttagacagcatccaaatcccctcctggaagatagactttgccaggggagaaattaaaatttctccgcaatctatttcagttgcaaaatctttgttaaagcttgatttaagcaggatcaaaaagaaagaatctaagattaaggaagcatatgcttcaggatcaaaatgatcttgctgtgtccatcgttttctaattatgtcatgtttatttctttctttacttataattatttctctgtttgtcatttctttcaaattcctcctgtctagtagaaaccataaaacaaaaataaaaaataaaaaataaataaaatcaaaataaaataaaaatcaaaaaatgaaataaaaacaacaaaaaaattaaaaacaaaaaaccaaaaaagatcccgaaagggacaattttggccaaatttgggttttgtttttgttttttgttttttgttttttgtttttatttttattttatttatttttatttattttattttatttttgtttttattttatgtttttgttgtttttgttattttgttatttattaagcacaacacacagaaagcaaactttaattaaacacacttattaaaatttaacacactaagcaagcacaagcaataaagataaagaaagctttatatatttataggcttttttataatttaacttacagctgcttttaagcaagttctgtgagttttgcctgttttttaaccccaaacatttcatagaacttgttaagagtttcgctgtaatgttccatagcaatacttcctttagcattaggattgctggagctaagtatagcagcatactctttccccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaattctgtctgaagttttctttatggtaattctaccaaaagtaaaatcactttgcttaataaccttcattatgctctgacgattcttcaggaatgtcagacatgaaataatgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgcaactcaaggtgcaaaagtgcaactctgtatcccgcagtcgtttcttagggttttaatgtgatgatttgtaagactgagtgttaaggtttgaataaaattgacacaattgctct

SEQ ID NO: 313 - DNA, 2923 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcaggcaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcactatctgtttgctcaaatacagtcaatgctaacggagtgaaacatcaaggtcatttgaaggttttgtctcctgctcagctccactctattggatctatcatgaacagatctgatatcacagaccgattccagctccaagaaaaagacataattcccaatgacagatacattgaagctgcaaacagaggctttttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctttggctaagggttccaaaggttttgaagcagatttccattcagaaattgttcaaggttgcaggagatgagacaaataaaacattttatttatctattgcctgcattccaaaccataacagtgttgagacagctttaaacattactgttatttgcaagcatcagctcccaattcgtaaatgtaaagctccttttgaattatcaatgatgttttctgatttaaaggagccttacaacattgttcatgatccttcatatccccaaaggattgttcatgctctgcttgaaactcacacatctttcgcacaagttctttgcaacaacttgcaagaagatgtgatcatctacaccttgaacaaccatgagctaactcctggaaagttagatttaggtgaaagaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaatgatcttgctgtgtccagctttttctaattatgttatgtttattttctttctttacttacaattatttctctgtttgtcatttctttcaaatttctcctgtctagtagaaaccataaaaacaaaaataaaaataaaataaatcaaaataaaataaaaatcaaaaaatgaaataaaaacaacaaaaaaataaaaaacaaaaaaccaaaaaagatcccgaaagggacaattttggccaaatttgggttttgtttttgttttttgtttttgttttttgttttttatttttattttatttattttattttattttattttatttttgttcttattttatgttttttgttgtttttgttattttgttatttatcaagcacaacacacagaaagcaaactttaattaaacacacttatataaaatttaacacactaagcaagcacaagcaataaagataaagaaagctttatatatttataggcttttttataatttaacttacagctgtttttaagcaagttctgtgagttttacctgttttttaaccccaaacatttcatagaacttgttaagagtttcactgtaatgttccatagcaatacttcctttagcattaggattgctggagctaagtatagcggcatactctttccccttcttcacctgatcttcattcatttcaaatgctttgcttttcagcacagtgcaaacttttcctaaggcttccctggtgtcatacttctttgggtcgatcccgaggtccttgtattttgcatcctgatatatagccaagacaacactgatcatctcaaagctatcaactgaagcaataagaggtaagctacctcccagcattatggcaagcctcacagactttgcatcatcaagaggtaatccataggcttgaaccaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattctaccaaaagtaaaatcactttgcttaataaccttcattatgctctgacgattcttcaggaatgtcagacatgaaataacgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacataatgatcgtagaagttgttatatgctttgaccgtatgtaattcaagatgcaaaagtgcaactctgtatcccgcagtcgtttcttagggttttaatgtgatgatttgtaagactgagtgttaaggtttgaataaaattgacacaattgctct

SEQ ID NO: 314 - DNA, 2959 bp, Tomato spotted wilt virus
agagcaattgtgtcataattttattcttaatcaaacctcacttagaaaatcacaatactgtaataaggacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttggctatactgcaaaggtagggaatcttccctgtgaagaagaagagattctttctcagcatgtgtatatccctatttttgatgatattgattttagcattaatattgatgactctgttctggcactatctgtttgctcaaatacagtcaatactaacggagtgaaacatcaaggtcatttgaaagttttgtctcctgcccagctccactctattggatctaccatgaacagatctgatattacagaccgattccagcttcaagaaaaagacataattcccaatgacagatacatcgaagctgcaaacaaaggctctttgtcttgtgtcaaagagcatacctataagatcgagatgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctctgctcatgtcagcagaaaacaacatcatgcctaactctcaggcttttgtcaaagcttccactgattctcatttcaaactgagcctctggctaagggtcccaaaggttctgaagcaggtctctattcagaaattgttcaaagttgcaggagacgaaacaaataaaacattttatttatctattgcttgcattccaaaccataacagtgttgagacagctttaaacatttctgttatttgcaagcatcagctcccaattcgtaaatgtaaagctccttttgaattatcaatgatgttttctgatttaaaggagccttacaacattgttcatgatccttcatatcctcagaggattgttcatgctctgcttgaaactcacacatcttttgcacaagctctttgcaacaacttacaagaagatgtgatcatctacactttgaacaactatgagctaactcctggaaagttagatttaggtgaaagaaccttaaattacagtgaagatatctgcaaaaggaaatatttcctttcaaaaacacttgaatgtcttccatctaacacacaaactatgtcttacttgggcagcatccagatcccttcctggaagatagactttgccaggggagaaattaagatttccccacaacctgtttcagttgcaaaatctttgttaaagcttgatttaagcgggatcgaaaagaaagaatctaagattccggaaacatatgcttcaggatcaaaataatcttgctgtgtccggtttttctaattatgttatgtttattttctttctttacttataattatttctctgttttgtcatttcttttaagttcctcctgtttaatagaaaccataaaacaaaaaataaaaaataaaaataaaatcaaaaatgaaacaaaaatcaaaaaatgaaacaaaaataaaaaataaaaaatgaaataaaaacaacaaaaaaattaaaaaacaaaaacccaaaaaagatcccgaaagggacaatcttggccaaatttgggttttgttttgtttttgttttttgttttttgtttttatttttattttatttatttattttattttatttttattttttattttgttttttattttatgttttttgttgtttttgttattttgtttatctattaagcataacacacagaaagcaaactttaattaaacacacttattttaaatttaacacactaagcaagcacaagcaataaagataaagaaagctttatatatttgtagacttttccataatttaacttacagctgattttaagcaagttctgcgagttttgcctgttttttaaccccgaacatttcatagaacttgttaagagtttcactgtaatgttccatagcaatacttcctttagcattaggattgctggagctgagtatagcagcatactcttttcctttcttcacctgatcttcattcatttcaaatgctttgcttttcagcacagtgcaaacttttcctaaggcttctctggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacagagcaacaatgctttccttagtgagcttaaccttagacatgatgattgtagaagttgttatatgctttgaccgtatgtaattcaaggtgcgaaagtgcaactctgtattccgcagtcgtttcttagggttttaatgtgatgatttgtaagactgagtgttaaggtttgaataaaattgacacaattgctct

SEQ ID NO: 315 - DNA, 3021 bp, Tomato spotted wilt virus
agagcaattgtgtcataattttattcttaatcaaacctcacttagaaaatcacaaaactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgactcaagaagcaaaagtagctttggctatactgcaaaagtaggggatcttccttgtgaagaagaagagattctttctcagcatgtgtatatccctatttttgatgatattgattttagcatcaatattgatgactctgttctggcactatctgtttgctcaaatacagtcaatgctaacggagtgaaacatcaaggtcatttgaaggttttgtctcctgctcagctccattctattggatctatcatgagcagatctgatattacagaccgattccagctccaagaaaaagacataattcccaatgacagatacattgaagctgcaaacaaaggctctttgtcttgtgttaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaggttgcaggagatgagacaaataaaacattttatttatctattgcctgcattccaaaccataacagtgttgagacagctttaaacattactgttatttgcaagcatcagctcccaattcgtaaatgcaaagctcctttcgaattatcaatgatgttttctgatttaaaggagccttacaacattgttcatgacccttcatatccccaaaggattgttcatgctctgcttgaaactcacacatcttttgcacaagttcttagcaacaatttgcaagaagatgtgatcatttacaccttgaacaaccatgagctaacccctggaaagttagatttaggtgaaagaaccttgaattacagtgaagatgcctacaaaaggaaatatttcctttcaaaaacacttgaatgtcttccaactaacacacaaactatgtcttatttagacagcatccaaatcccttcctggaagatagactttgccaggggagaaattaaaatttctccgcagtctatttcagttgcaaaatctttgttaaagcttgatttaagcgggatcaaaaagaaagaatctaaggttaaggaagcatatgcttcaggatcaaaatgatcttgctgtgtccagccttttctaattatgttatgtttattttctttctttacttataattatttctctatttgtcatttctttcaaattcctcctgtctagtagaaaccataaaaacaaaaataaaaataaaataaaatcaaaataaaataaaatcaaaaaatgaaataaaaaacaaaaaatattaacaaaaaaacccaaaaagatcccgaaagggacaattttggccaaatttgggtttgtttttgttgttttttgttttttgttttttgtttttattttattttattttatttatttttattttatttttgtttttatcttatgtttttttgttgtttttgttattttgttatttattaagcacaacacacagaaagcaaactttattttattttatttattttattttatttttgttcttatcttatgttttttgttgtttttgttattttgttatttattaagcataacacacagaaagcaaactttaattaaacacacttatttaaaatttaacacactaagcaagcataagcaataaagataaagaaagctttatatatttataggctttgtataatttaacttacagctgcttttaggcaagttctgtgagttttgcctgttttttaaccccaaacatttcatagaacttgttaagagtttcactgtaatgttccatagcaacacttcctttagcattaggattgctggaactaagtatagcagcatactctttccccttcttcacctgatcttcagtcatttcaaatgctttgcttttcagcacagtgcaaactttccctaaggcttccctggtgtcatacttcttcgggtcaatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattttaccaaaagtaaaatcactttgcttaataaccttcattatgctctgacgattcttcaggaatgtcagacatgaaataatgctcatctttttgatctggtcaaggtttcctagacaaaaagtcttgaagttgaatgctaccagattctgatcctcctcaaactcaaggtctttgccttgtgtcaacaaagcaacaatgctttccttagtgagcttaaccttagacatgatgatcgtagaagttgttatatgctttgaccgtatgtaattcaaggtgcaaaagtgcaactctgtatcccgcagtcgtttcttagggttttaatgtgatgatttgtaagactgagtgttaaggtttgaataaaattgacacaattgctct

SEQ ID NO: 316 - DNA, 2954 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttcttcactagttcaaacccagctgtattctgattcaagaagcaaaagtagctttggctatactgcaaaggtagggaatcttccctgtgaagaagaagagattctttctcagcatgtgtatatccctatttttgatgatattgattttagcattaatattgatgactctgttctggcactatctgtttgctcaaatacagtcaatactaacggagtgaaacatcaaggtcatttgaaagttttgtctcctgctcagctccactctattggatctaccatgaacagatctgatattacagaccgattccagcttcaagaaaaagacataattcccaatgacagatacatcgaagctgcaaacaaaggctctttgtcttgtgtcaaagagcatacctataagatcgagatgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctctgctcatgtcagcagaaaacaacatcatgcctaactctcaggcttttgtcaaagcttccactgattctcatttcaaactgagcctctggctaagggtcccaaaggttctgaagcaggtctctattcagaaattgttcaaagttgcaggagacgaaacaaataaaacattttatttatctattgcttgcattccaaaccataacagtgttgagacagctttaaacatttctgttatttgcaagcatcagctcccaattcgtaaatgtaaagctccttttgaattatcaatgatgttttctgatttaaaggagccttacaacattgttcatgatccttcatatcctcagaggattgttcatgctctgcttgaaactcacacatcttttgcacaagttctttgcaacaacttacaagaagatgtgatcatctacactttgaacaactatgagctaactcctggaaagttagatttaggtgaaagaaccttaaattacagtgaagatatctgcaaaaggaaatatttcctttcaaaaacacttgaatgtcttccatctaacacacaaactatgtcttacttggacagcatccaaatcccttcctggaagatagactttgccaggggagaaattaagatttccccacaacctgtttcagttgcaaaatctttgttaaagcttgatttaagcgggatcgaaaagaaagaatctaagattccggaaacatatgcttcaggatcaaaataatcttgctgtgtccggtttttctaattatgttatgtttattttctttctttacttataattatttctctgtttgtcatttcttttaagtttctcctgtttaatagaaaccataaaacaaaaaataaaataaaaataaaatcaaaaatgaaacaaaaatcaaaaaatgaaacaaaaataaaaaataaaaatgaaataaaaacaacaaaaaaattaaaaaacaaaaacccaaaaaagatcccgaaagggacaatcttggccaaatttgggttttgttttgtttttgttttttgttttttgtttttatttttattttatttatttattttattttatttttattttttatttgttttttattttatgttttttgttgtttttgttattttgtttatttattaagcataacacacagaaagcaaactttaattaaacacacttattttaaatttaacacactaagcaagcacaagcaataaagataaagaaagctttatatatttgtagacttttccataatttaacttacagctgattttaagcaagttctgcgagttttgcctgttttttaaccccgaacatttcatagaacttgttaagagtttcactgtaatgttccatagcaatacttcctttagcattaggattgctggagctgagtatagcagcatactcctttcctttcttcacctgatcttcattcatttcaaatgctttgcttttcagcacagtgcaaactttccctaaggcttctctggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgtatgtaattcaaggtgcgaaagtgcaactctgtattccgcagtcgtttcttagggttttaatgtgatgatttgtaagactgagtgttaaggtttgaataaaattgacacaattgctct

SEQ ID NO: 317 - DNA, 2922 bp, Tomato spotted wilt virus
agagcaattgtgtcataattttattcttaatcaaacctcacttagaaaatcacaatactgtaataagaacacagtaccaatagccataatgtcttcaagtgtttatgagtcgatcattcagacaagagcttcagtctggggatcaactgcatctggtaaagctgttgtagattcttactggattcacgaacttggtactggttctcaactagttcagacccagctgtattctgattcaagaagcaaaagtagctttggctatactgcaaaagtgggggatcttccttgtgaagaagaagagattctttctcagcatgtgtatatccctatttttgatgatattgattttagcatcaatattgatgactctgttctggcactatctgtttgctcaaatacagtcaatgctaacggagtgaaacatcaaggccatttgaaggttttgtctcctgctcagctccactctattggatctatcatgaacagatctgatattacagaccgattccagcttcaagaaaaagacataattcccaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaagtcgcaggagatgagacaaataaaacattttatttatccattgcctgcattccaaaccataacagtgttgagacagctttaaacattactgttatttgcaagcatcagcttccaattcgtaaatgtaaagctccttttgaattatcaatgatgttttctgatttaaaggagccttacaacattgttcatgatccttcatatccccaaaggattgttcatgctttgcttgaaactcacacatcttttgcacaggttctttgcaacaacttgcaagaagatgtgatcatctacaccttgaacaaccatgagctaacttctggaaagctagatttaggtgaaagaaccttgaattacagtgaagatgcctacaaaaggaaatatttcctttcaaaaacacttgaatgtcttccatctaacacacaaactatgtcttatttagacagcatccaaattccttcctggaagatagactttgccaggggagaaattaaaatttctccgcaatctattccagttgcaaaatctttgttaaagcttgatttaagcgggatcaaaaagaaagaatctaagattaaggaagcatatgcttcaggatcaaaatgatcttgctatgtccagcttttcctaattatgttatgtttattttctttctttacttataattatttctctgtttgtcatttctttcaaattcctcctgtctagtagaaaccataaaaacaaaaataaaaataaaataaaatcaaaataaaataaaaatcaaaaaatgaaataaaaacaacaaaaaaataaaaaacaaaaaaccaaaaaagatcccgaaagggacaattttggccaaatttgggttttgtttttgttttttgttttttgttttttgtttttatttttatttatttattttattttattttattttatttttgtttttattttatgttttttgttgtttttgttattttgttatttattaagcacaacacacagaaagcaaactttaattaaacacacttatttaaaatttaacacactaagcaagcacaagcaataaagataaagaaagctttatatatttataggctttttataatttaacttacagctgcttttaagcaagttctgtgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatctcaaatgctttgcttttcagcacagtgcaaacttttcctaaagcttccctggtgtcatacttctttgggtcgatcccgaggtccttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattttaccaaaagtaaaatcactctgcttgataaccttcattatgctctgacgattcttcaggaatgtcagacatgaaataacgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctctgaccgtatgtgattcaaggtgcaaaagtgcaactctgtatcccgcagtcgtttcttagggttttaatgtgatgatttgtaagactgagtgttaaggtttgaataaaattgacacaattgctct

SEQ ID NO: 318 - DNA, 2923 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcacgaacttggtactggttctcaactagttcagacccagctgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcactatctgtttgctcaaatacagtcaatgctaacggagtgaaacatcaaggtcatttgaaggttttgtctcctgctcagctccactctattggatctatcatgaacagatctgatattacagaccgattccagctccaagaagaagacataattcccaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaagtcgcaggagatgagacaaataaaacgttttatttatctattacctgcattccaaaccataacagtgttgagacagctttaaacattactgttatttgcaagcatcagcttccaattcgtaaatgtaaagctccttttgaattatcaatgatgttttctgatttaaaggagccttacaacattgttcatgatccttcatatccccaaaggattgttcatgctttgcttgaaactcacacatcttttgcacaggttctttgcaacaacttgcaagaagatgtgatcatctacaccttgaacaaccatgagctaacttctggaaagctagatttaggtgaaagaaccttgaattacagtgaagatgcctacaaaaggaaatatttcctttcaaaaacacttgaatgtcttccatctaacacacaaactatgtcttatttagacagcatccaaattccttcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaataatcttgctatgtccagcttttcctaattatgttatgtttattttctttctttacttataattatttctctgtttgtcatttctttcaaattcctcctgtctagtagaaaccataaaaacaaaaataaaaataaaataaaatcaaaataaaataaaaattaaaaaatgaaataaaaacaacaaaaaaataaaaaacaaaaaaccaaaaaagatcccgaaagggacaattttggccaaatttgggttttgtttttgttttttgttttttgttttttgtttttatttttatttatttatttttattttattttattttatttttgtttttattttatgttttttgttgtttttgttattttgttatttattaagcacaacacacagaaagcaaactttaattaaacacacttatttaaaatttaacacactaagcaagcacaagcaataaagataaagaaagctttacatatttataggctttttataatttaacttacagctgcttttaagcaagttctgtgagttttgcttgttttttaaccccaaacatttcatagaacttgttaagagtttcactgtaatgttccatagcaatacttcctttagcattaggattgctggagctaagtatagcagcatactctttccccttcttcacctgatcttcattcatctcaaatgctttgcttttcagcacagtgcaaacttttcctaaagcttccctggtgtcatacttctttgggtcgatcccgaggtccttgtattttgcatcttgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattttaccaaaagtaaaatcactctgcttaataaccttcattatgctctgacgattcttcaggaatgtcagacatgaaataacgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctctgaccgtatgtgattcaaggtgcaaaagtgcaactctgtatcccgcagtcgtttcttagggttttaatgtgatgatttgtaagactgagtgttaaggtttgaataaaattgacacaattgctct

SEQ ID NO: 319 - DNA, 3047 bp, Tomato spotted wilt virus
agagcaattgtgtcagaattttgttcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccagctgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcactatctgtttgctcaaatacagtcaatgctaacggagtgaaacatcaaggtcatttgaaggttttgtctcctgctcagctccactctattggatctatcatgaacagatctgatattacagaccgattccagctccaagaaaaagacataattcccaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatccctgctcatgttagcagaaaacaacatcatgcctaactctcaagcttttgtcaaagcttctactgattctaatttcaagctgagcctctggctaagggttccaaaggttttgaagcagatttccattcggaaattgttcaaggttgcaggggatgagacaaataaaacattttatttatctattgcctgcataccaaaccataacagtgttgagacagctttgaacattactgttatttgcaagcatcagctcccaattcgtaaatgtaaaactccttttgaattatcaatgatgttttctgatttaaaggagccttacaacattattcatgatccttcatatcctcaaaggattgttcatgctctgcttgaaactcacacatcttttgcgcaagttctttgcaacaacttgcaagaagatgtgatcatctacaccttgaacaaccatgagctaactcctgaaaagttagatttaggtgaaataaccttgaattacaaagaagacgcctacaaaaggaaatatttcctttcaaaaacacttgaatgtcttccatctaacacacaaactatgtcttacttagacagcatccaaatcccttcctggaagatagactttgccaggggagaaattaaaatttctccacaatctatttcagttgcaaaatctttgttaaatcttgatttaagcgggattaaaaagaaagaatctaagattaaggaagcatatgcttcaggatcaaaatgatcttgctgtatcctgctttttctaattatgttatgtttgtttctttctttacttataattatttctctgtttgtcatttccttcaaactcctcctgtctagtagaaaccataaaaacaagaataaaaataaaataaaatcaaaataaaataaaaatcaaaaaatgaaataaaaacaacaaaaaattaaaaaacaaaaaaccaaaaaagatcccgaaagggacaattttggccaaatttgaggtttgtttttgtttgtttgtttgtttgtttgtttgtttgtttgtttgtttgtttgtttgtttgtttgtttgtttgtttgtttgtttgtttgtttgtttgttttgtttgttttgtttgtttttttgttttttgtttttgtttttgtttttatttttattttttattttatttttatttttgttttattttattttatttttgtttttattttatgtttttttgttgtttttgttattttgttatttattaagcacaacacacagaaagcaaactttaattaaacacacttatttaaaatttaacacactaagcaagcacaagcaataaagataaagaaagctttatacatttacaggctttttataatttaacttacagctgctttcaagcaagttctgtgagttttgcctgttttttaaccccaaacatttcatagaacttgttaagagtttcactgtaatgttccatagcaacacttcctttagcattaggattgctggaactgagtatagcagcatactctttccccttcttcacctgatcttcagtcatttcaaatgctttgcttttcagcacagtgcaaactttccctaaggcttctctggtgtcatacttctttgggtcgatcccgaggtccttgtattttgcatcctgatatatagccaagacaacactgatcatctcaaagctatcaactgaagcaataagaggtaagctacctcctagcattatggcaagcctcacagactttgcatcatcaagaggtaatccataggcttgaatcaaagggtgggaagcaatcttagatttgatagtattgagattctcagaattcccagtttcctcaacaagcctgaccctaatcaagctatcaagccttctgaaggtcatgtcagtggctccaatcctgtctgaagttttctttatggtaattttaccaaaagtaaaatcactttgcttgataaccttcattatgctctgacgattcttcaggaatgtcagacatgaaataatgctcatctttttgatctggtcaaggtttcccagacaaaaagtcttgaagttgaatgctaccagattctgatcttcctcaaactcgaggtctttgccttgtgtcaacaaagcgacaatgctttccttagtgagcttaaccttagacatgatgatcgtagaagttgttatatgctttgaccgtatgtaattcaaggtgcaaaagtgcaactctgtatgccgcagtcgtttcttagggttttaatgtgatgatttgtaagactgagtgttaaggtttgaacacaaaattgacacgattgctct

SEQ ID NO: 320 - DNA, 3016 bp, Tomato spotted wilt virus
agagcaattgtgtcagaattttgttcttaatcaaacctcacttagaaaatcacaaaactgtaataagaacacagtaccaataaccataatgtcttcaagtgtttatgagtcaatcattcagacaagagcttcagtctggggatcaactgcatctggtaaagctgttgtagattcttactggattcatgaacttggtactggttctcaactagttcagacccagctgtattctgattcaagaagcaaaagtagctttggctatactgcaaaagtaggggatcttccctgtgaagaagaagagattctttctcagcatgtgtatatccctatttttgatgatattgattttagcatcaatattgatgactctgttctggcactatctgtttgctcaaatacagtcaatgctaacggagtgaaacatcaaggtcatttgaaggttttgtctcctgctcaactccattctattggatctatcatgagcagatctgatattacagaccgattccagctccaagaaaaagacataattcccaatgacagatacattgaagctgcaaacaaaggctctttgtcttgtgtcaaagagcatacctataagatcgaaatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcgtttgtcaaagcttccactgattctcatttcaagctgagcctctggctaagggttccaaaggttttgaagcagatttccattcagaaattgttcaaggttgcgggagatgagacaaataaaacattttatttatctattgcctgcattccaaaccataacagtgttgagacagctttaaacattactgttatttgcaagcatcagctcccaattcgtaaatgcaaagctcctttcgaattatcaatgatgttttctgatttaaaggagccttacaacattgttcatgatccttcatatccccaaaggattgttcatgctctgcttgaaactcacacatcttttgcacaagttcttagcaacaatttgcaagaagatgtgatcatctacaccttgaacaaccatgagctaactcctggaaagttagatttaggtgaaagaaccttgaattacagtgaagatgcctacaaaaggaaatatttcctttcaaaaacacttgaatgtcttccaactaacacacaaactatgtcttacttagacagcatccaaatcccttcttggaagatagactttgccaggggagaaattaaaatttctccgcagtctatttcagttgcaaaatctttgttaaagctcgatttaagcgggatcaaaaagaaagaatctaaggttaaggaagcatatgcttcaggatcaaaatgatcttgctgtgtccagccttttctaattatgttatgtttattttctttctttacttataattatttctctatttgtcatttctttcaaattcctcctgtctagtagaaaccataaaaacaaaaataaaataaaataaaatcaaaataaaataaaatcaaaaaatgaaataaaaaacaaaaaataaaacaaaaaaccaaaaaagatcccgaaagggacaattttggccaaatttgggtttgtttttgttgtttttgttttttgttttttgtttttattttattttattttatttatttttattttatttttgttttatcttatgtttttttgttgtttttgttattttgttatttattaagcacaacacacagaaagcaaactttattttatcttatttatttttattttatttttgttcttatcttattttttgttgttttgttattttgttatttattaagcacaacacacagaaagcaaactttaattaaacacacttatttaaaatttaacacactaagcaagcacaagcaataaagataaagaaagctttatatatttgtaggctttttataatttaacttacagctgctttcaagcaagttctgtgagttttgcctgttttttaaccccaaacattccatagaacttgttaagagtttcactgtaatgttccatagcaacacttcctttagcattaggattgctggagctaagtatagcagcatactccttccccttcttcacctgatcttcattcatttcaaatgctttgcttttcagcacagtgcaaactttccctaaggcttccctggtgtcatacttctttgggtcgatcccgaggtccttatattttgcatcctgatatatagccaagacaacactgatcatctcaaagctatcaactgaagcaataagaggtaagctacctcccagcattatggcaagcctcacagactttgcatcatcaagaggtaatccataagcttgaatcaaagggtgggaagcaatcttagatttgatagtattgagattctcagaattcccagtttcttcaacaagcctgaccctgatcaagctatcaagccttctgaaggtcatgtcagtggctccgatcctgtctgaagttttctttatggtaattttaccaaaagtaaaatcactttgcttaataaccttcattatgctctgacgattcttcaggaatgtcagacatgaaataatgctcatctttttgatctggtcaaggttttccagaaaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtgcaactctgtatcccgcagtcgtttcttagggttttaatgtgatgatttgtaagactgagtattaaggtttgaacacaaaattgacacgattgctct

SEQ ID NO: 321 - DNA, 2927 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcattatctgtttgctcaaatgcagtcaatgctaatggagtgaaacatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaagagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagtgttgagacagctttaaacattactgttatttgcaaacatcagctcccaattcgtaaatttaaagctccttttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctatttcagttgcaaaatctttgttaaagcttgatttaagcgggatcaaaaagaaagaatctaagattaaggaagcacatgcttcaggatcaaaatgatcttgctgtgtccagctttttctaattatgttatgtttattttcctcctttacttataattatttctctgtttgtcatttctttcaaattcctcctgcctagtagaaaccataaaaacaaaaataaaaataaaataaaatcaaaataaaataaaaatcaaaaaatgaaataaaacaacaaaaaattaaaaaacaaaaaaccaaaaaagatcccgaaagggacaattttggccaaatttgggttttgtttttgttttttgttttttgttttttgttttttatttttattttttattttttattttactttattttatttttatttgtttttattttatgtttttttgttggttttttattatgttatttattaagcacaacacacagaaagcaaactttaattaaacacacttatttaaaatttaacacactaagcaagcacaagcaataaagataaagaaagctttatatatttataggttttttataatttaacttacagctgcttttaagcaagttctgcgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtcagtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtacaactctgtatcccgcagtcgtttcttagggttttaatgtgatgatttgtaagactgagtgttaaggtttgaataaaattgacacaattgctct

SEQ ID NO: 322 - DNA, 2927 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcattatctgtttgctcaaatacagtcaatgctaatggagtgaaacatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaagagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagtgttgagacagctttaaacattactgttatttgcaaacatcagctcccaattcgtaaatttaaagctccttttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctatttcagttgcaaaatctttgttaaagcttgatttaagcgggatcaaaaagaaagaatctaagattaaggaagcacatgcttcaggatcaaaatgatcttgctgtgtccagctttttctaattatgttatgtttattttcctcctttacttataattatttctctgtttgtcatttctttcaaattcctcctgcctagtagaaaccataaaaacaaaaataaaaataaaataaaatcaaaataaaataaaaatcaaaaaatgaaataaaacaacaaaaaattaaaaaacaaaaaaccaaaaaagatcccgaaagggacaattttggccaaatttgggttttgtttttgttttttgttttttgttttttgttttttatttttattttttattttttattttactttattttatttttatttgtttttattttatgtttttttgttggttttttattatgttatttattaagcacaacacacagaaagcaaactttaattaaacacacttatttaaaatttaacacactaagcaagcacaagcaataaagataaagaaagctttatatatttataggttttttataatttaacttacagctgcttttaagcaagttctgcgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtcagtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtacaactctgtatcccgcagtcgtttcttagggttttaatgtgatgatttgtaagactgagtgttaaggtttgaataaaattgacacaattgctct

SEQ ID NO: 323 - DNA, 2925 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcattatctgtttgctcaaatacagtcaatgctaatggagtgaaacatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaagagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagcgttgagacagctttaaacattactgttatttgcaaacatcagctcccaattcgtaaatttaaagctcctcttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagtatccaaatcccttcctggaagatagactttgccaggggagaaattaaaatttctccgcaatctatttcagttgcaaaatctttgttaaagcttgatttaagcgggatcaaaaagaaagaatctaagattaaggaagcacatgcttcaggatcaaaatgatcttgctgtgtccagctttttctaattatgttatgtttattttcctcctttacttataattatttctctgtttgtcatttctttcaaattcctcctgcctagtagaaaccataaaaacaaaaataaaaataaaataaaatcaaaataaaataaaaatcaaaaaatgaaataaaaacaacaaaaaaattaaaaacaaaaaaccaaaaaagatcccgaaagggacaattttggccaaatttgggttttgtttttgttttttgttttttgttttgtttttatttttattttttattttttattttactttattttatttttatttgtttttattttatgttttttgttggtttttttattatgttatttattaagcacaacacacagaaagcaaactttaattaaacacacttatttaaaatttaacacactaagcaagcacaagcaataaagataaagaaagctttatatatttataggttttttataatttaactcacagctgcttttaagcaagttctgcgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtcagtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtacaactctgtatcccgcagtcgtttcttagggttttaatgtgatgatttgtaagactgagtgttaaggtttgaataaaattgacacaattgctct

SEQ ID NO: 324 - DNA, 2927 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtatatccctatttttgatgttattgattttagcatcaatattgatgactctgttctggcattatctgtttgctcaaatacagtcaatgctaatggagtgaaacatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaagagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagtgttgagacagctttaaacattactgttatttgcaaacatcagctcccaattcgtaaatttaaagctccttttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctgtttcagttgcaaaatctttgttaaagcttgatttaagcgggatcaaaaagaaagaatctaaaattaaggaagcacatgcttcaggatcaaaatgatcttgctgtgtccagctttttctaattatgttatgtttattttcctcctttacttataattatttctctgtttgtcatttctttcgaattcctcctgcctagtagaaaccataaaaacaaaaatgaaaataaaataaaatcaaaataaaataaaaatcaaaaaatgaaataaaaacaacaaaaaattaaaaaacaaaaaaccaaaaaagatcccgaaagggacaattttggccaaatttgggttttgtttttgttttttgttttttgttttttgttttttatttttattttttattttttattttattttattttattttatttgtttttattttatgttttttgttggtttttttattatgttatttattaagcacaacacacagaaagcaaactttaattaaacacacttatttaaaatttaacacactaagcaagcacaagcaataaagataaagaaagctttatatatttataggttttttataatttaacttacagctgcttttaagcaagttctgcaagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtctgtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtacaactctgtatcccgcagtcgtttcttagggttttaatgtgatgatttgtaagactgagtgttaaggtttgaataaaattgacacaattgctct

SEQ ID NO: 325 - DNA, 2934 bp, Tomato spotted wilt virus
agagcaattgggccataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtgtatccctatttttgatgatattgattttagcatcaatattgatgactctgttctggcattatctgtttgctcaaatacagtcaatgctaatggagtgaaacatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaggagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagtgttgagacagctttaaacattactgttatttgcaaacatcagctcccaattcgtaaatttaaagctccttttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctatttcagttgcaaaatctttgttaaagcttgatttaagcgggatcaaaaagaaagaatctaaaattaaggaagcacatgcttcaggatcaaaatgatcttgctgtgtccagctttttctaattatgttatgtttattttcctcctttgcttataattatttctctgtttgtcatttctttcaaattcctcctgcctagtagaaaccataaaaccaaaaataaaaataaaataaaatcaaaataaaataaaaatcaaaaaatgaaataaaaacaacaaaaaattaaaaaacaaaaaaccaaaaaagatcccgaaagggacaattttggccaaatttgggttttgtttttgttttttgttttttgttttttgttttttatttttattttttattttttattttttattttactttattttatttttatttgtttttattttatgttttttgttggttttttattatgttatttattaagcacaacacacagaaagcaaactttaattaaacacacttatttaaaatttaacacactaagcaagcacaagcaataaagataaagaaagctttatatatttataggttttttataatttaacttacagctgcttttaagcaagttctgcgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtcagtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtgcaactctgtatcccgcagtcgtttcttagggttttaatgtgatgatttgtaagactgagtgttaaggtttgaataaaattgacacaattgctct

SEQ ID NO: 326 - DNA, 2927 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtatatccctatctttgatgatattgattttagcatcaatattgatgactctgttctggcattatctgtttgctcaaatacagtcaatgctaatggagtgaatcatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaagagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagtgttgagacagctttaaacattactgttatttgcaaacatcagctcccaattcgtaaatttaaagctccttttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctgtttcagttgcaaaatctttgttaaagcttgatttaagcgggatcaaaaagaaagaatctaaaattaaggaagcacatgcttcaggatcaaaatgatcttgctgtgtccagctttttctaattatgttatgtttattttcctcctttacttataattatttctctgtttgtcatttctttcgaattcctcctgcctagtagaaaccataaaaacaaaaataaaaataaaataaaatcaaaataaaataaaaatcaaaaaatgaaataaaaacaacaaaaaattaaaaaacaaaaaaccaaaaaagatcccgaaagggacaattttggccaaatttgggttttgtttttgttttttgttttttgttttttgttttttatttttattttttatttttcattttactttattttatttttatttgtttttattttatgttttttgttggttttttattatgttatttattaagcacaacacacagaaagcaaactttaattaaacacacttatttaaaatttaacacactaagcaagcacaagcaataaagataaagaaagctttatatatttataggttttttataatttaacttacagctgcttttaagcaagttctgcgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtctgtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtacaactctgtatcccgcagtcgtttcttagggttttaatgtgatgatttgtaagactgagtgttaaggtttgaataaaattgacacaattgctct

SEQ ID NO: 327 - DNA, 2926 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatttgtatatccctatttttgatgatattgattttagcatcaatattgatgactctgttctggcattatctgtttgctcaaatacagtcaatgctaatggagtgaaacatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaagagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgttagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagtgttgagacagctttaaacattactgttatttgcaaacatcagctcccaattcgtaaatttaaagctccttttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctatttcagttgcaaaatctttgttaaagcttgatttaagcgggatcaaaaagaaagaatctaagattaaggaagcacatgcttcaggatcaaaatgatcttgctgtgtccagctttttctaattatgttatgtttattttcctcctttacttataattatttctctgtttgtcatttctttcaaattcctcctgcctagtagaaaccataaaaacaaaaataaaaataaaataaaatcaaaataaaataaaaatcaaaaaatgaaataaaacaacaaaaaattaaaaaacaaaaaaccaaaaaagatcccgaaagggacaattttggccaaatttgggttttgtttttgttttttgttttttgttttttgttttttatttttattttttatttttattttactttattttatttttatttgtttttattttatgtttttttgttggttttttattatgttatttattaagcacaacacacagaaagcaaactttaattaaacacacttatttaaaatttaacacactaagcaagcacaagcaataaagataaagaaagctttatatatttataggttttttataatttaacttacagctgcttttaagcaagttctgcgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtcagtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtacaactctgtatcccgcagtcgtttcttagggttttaatgtgatgatttgtaagactgagtgttaaggtttgaataaaattgacacaattgctct

SEQ ID NO: 328 - DNA, 2922 bp, Tomato spotted wilt virus
agagcaattgtgtcataattttattcttaatcaaacctcacttagaaaatcacaatactgtaataagaacacagtaccaataaccatgatgtcttcaagtgtttatgagtcgatcattcagacaagagcttcggtctggggatcaactgcatctggtaaagctgttgtagattcttactggattcacgaacttggtactggttctcaactagttcagacccagctgtattctgattcaagaagcaaaagtagctttggctatactgcaaaagtaggggatcttccttgtgaagaagaagagattctttctcagcatgtgtatatccctatttttgatgatattgattttagcatcaatattgatgactctgttctggcactatctgtttgctcaaatacagtcaatgctaacggagtgaaacatcaaggtcatttgaaggttttgtctcctgctcagctccactctattggatctatcatgaacagatctgatattacagaccgattccagctccaagaaaaagacataattcccaatgacagatacattgaagctgcaaacaaaggatctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaagtcgcaggagatgagacaaataaaacattttatttatctattgcctgcattccaaaccataacagtgttgagacagctttaaacattactgttatttgcaagcatcagcttccaattcgtaaatgtaaagctccttttgaattatcaatgatgttttctgatttaaaggagccttacaacattgttcatgatccttcatatccccaaaggattgttcatgctttgcttgaaactcacacatcttttgcacaggttctttgcaacaacttgcaagaagatgtgatcatctacaccttgaacaaccatgagctaacttctggaaagctagatttaggtgaaagaaccttgaattacagtgaagatgcctacaaaaggaaatatttcctttcaaaaacacttgaatgtcttccatctaacacacaaactatgtcttatttagacagcatccaaattccttcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaatgatcttgctatgtccagcttttcctaattatgttatgtttgttttctttctttacttataattattcctctgtttgtcatttctttcaaattcctcctgtctagtagaaaccataaaaacaaaaataaaaataaaataaaatcaaaataaaataaaaatcaaaaaatgaaataaaaacaacaaaaaaataaaaaacaaaaaaccaaaaaagatcccgaaagggacaattttggccaaatttgggttttgtttttgttttttgttttttgttttttgtttttatttttatttatttatttttattttatttattttatttttgtttttattttatgttttttgttgtttttgttattttgttatttattaagcacaacacacagaaagcaaactttaattaaacacacttatttaaaatttaacacactaagcaagcacaagcaataaagataaagaaagctttatatatttataggctttttataatttaacttacagctgcttttaagcaagttctgtgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatctcaaatgctttgcttttcagcacagtgcaaacttttcctaaagcttccctggtgtcatacttctttgggtcgatcccgaggtccttgtattttgcatcctgatatatagccaagacaacactgatcatctcaaagctatcaactgaagcaataagaggtaagctacctcccagcattatggcaagcctcacagactttgcatcatcaagaggtaatccataagcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattttaccaaaagtaaaatcactctgcttaataaccttcattatgctctgacgattcttcaggaatgtcagacatgaaataacgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctctgaccgtatgtgattcaaggtgcaaaagtgcaactctgtatcccgcagtcgtttcttagggttttaatgtgatgatttgtaagactgagtgttaaggtttgaataaaattgacacaattgctct

SEQ ID NO: 329 - DNA, 2922 bp, Tomato spotted wilt virus
agagcaattgtgtcataattttattcttaatcaaacctcacttagaaaatcacaatactgtaataagaacacagtaccaataaccatgatgtcttcaagtgtttatgagtcgatcattcagacaagagcttcagtctggggatcaactgcatctggtaaagctgttgtagattcttactggattcacgaacttggtactggttctcaactagttcagacccagctgtattctgattcaagaagcaaaagtagctttggctatactgcaaaagtaggggatcttccttgtgaagaagaagagattctttctcagcatgtgtatatccctatttttgataatattgattttagcatcaatattgatgactctgttctggcactatctgtttgctcaaatacagtcaatgctaacggagtgaaacatcaaggtcatttgaaggttttgtctcctgctcagctccactctattggatctatcatgaacagatctgatattacagaccgattccagctccaagaaaaagacataattcctaatgacagatacattgaagctgcaaacaaaggctctttgtcttgtgtcaaagagcatacctataagatcgagatgtgctataatcaagctttaggcaaagtgaatgttctatctcctaacagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaagctgagcctctggctaagggttccaaaggttttgaagcagatttccattcagaaattgttcaaagtcgcaggagatgagacaaataaaacattttatttatctattgcctgcattccaaaccataacagtgttgagacagctttaaacattactgttatttgcaagcatcagcttccaattcgtaaatgtaaagctccttttgaattatcaatgatgttttctgatttaaaggagccttacaacattgttcatgatccttcatatccccaaaggattgttcatgctttgcttgaaactcacacatcttttgcacaggttctttgcaacaacttgcaagaagatgtgatcatctacaccttgaacaaccatgagctaacttctggaaagctagatttaggtgaaagaaccttgaattacagtgaagatgcctacaaaaggaaatatttcctttcaaaaacacttgaatgtcttccatctaacatacaaactatgtcttatttagacagcatccaaattccttcctggaagatagactttgccaggggagaaattaaaatttctccgcaatctatttcagttgcaaaatctttgttaaagcttgatttaagcgggatcaaaaagaaagaatctaagattaaggaagcatatgcttcaggatcaaaatgatcttgctatgtccagcttttcctaattatgttatgtttgttttctttctttacttataattattcctctgtttgtcatttctttcaaattcctcctgtctagtagaaaccataaaaacaaaaataaaaataaaataaaatcaaaataaaataaaaatcaaaaaatgaaataaaaacaacaaaaaaataaaaaacaaaaaaccaaaaaagatcccgaaagggacaattttggccaaatttgggttttgtttttgttttttgttttttgttttttgtttttatttttatttatttatttttattttatttattttatttttgtttttattttatgttttttgttgtttttgttattttgttatttattaagcacaacacacagaaagcaaactttaattaaacacacttatttaaaatttaacacactaagcaagcacaagcaataaagataaagaaagctttatatatttataggctttttataatttaacttacagctgcttttaagcaagttctgtgagtttcgcctgttttttaaccccaaacatttcatagaacttgttaagagtttcactgtaatgttccatagcaatacttcctttagcattaggattgctggagctaagtatagcagcatactctttccccttcttcacctgatcttcattcatctcaaatgctttgcttttcagcacagtgcaaacttttcctaaagcttccctggtgtcatacttctttgggtcgatcccgaggtccttgtattttgcatcctgatatatagccaagacaacactgatcatctcaaagctatcaactgaagcaataagaggtaagctacctcccagcattatggcaagcctcacagactttgcatcatcaagaggtaatccataagcttgaatcaaagggtgggaagcaatcttagatttgatagtattgagattctcagaattcccagtttcctcaacaagcctgaccctgatcaagctatcaagccttctgaaggtcatgtcagtggctccaatcctgtctgaagttttctttatggtaattttaccaaaagtaaaatcactctgcttaataaccttcattatgctctgacgattcttcaggaatgtcagacatgaaataacgctcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctctgaccgtatgtgattcaaggtgcaaaagtgcaactctgtatcccgcagtcgtttcttagggttttaatgtgatgatttgtaagactgagtgttaaggtttgaataaaattgacacaattgctct

SEQ ID NO: 330 - DNA, 2961 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttggctatactgcaaaggtagggaatcttccctgtgaagaagaagagattctttctcagcatgtgtatatccctatttttgatgatattgattttagcattaatattgatgactctgttctggcactatctgtttgctcaaatacagtcaatactaatggagtgaaacatcaaggtcatttgaaagttttgtctcctgctcagctccactctattggatctaccatgaacagatctgatattacagaccgattccagcttcaagaaaaagacataattcccaatgacagatacatcgaagctgcaaacaaaggctctttgtcttgtgtcaaagagcatacctataagatcgagatgtgctataatcaagctttgggcaaagtgaatgttttatcccctaacaggaatgttcatgaatggctgtacagtttcaagccaagtttcaatcaagttgaaagcaacaacagaactgtaaattctcttgcagtgaaatctctgctcatgtcagcagaaaacaacatcatgcctaactctcaggcttttgtcaaagcttccactgattctcatttcaaactgagcctctggctaagggtcccaaaggttctgaagcaggtctctattcagaaattgttcaaagttgcaggagacgaaacaaataaaatattttatttatctattgcttgcattccaaaccataacagtgttgagacagctttaaacatttctgttatttgcaagcatcagctcccaattcgtaaatgtaaagctccttttgaattatcaatgatgttttctgatttaaaggagccttacaacattgttcatgatccttcatatcctcagaggattgttcatgctctgcttgaaactcacacatcttttgcacaagttctttgcaacaacttacaagaagatgtgatcatctacactttgaacaactatgagctaactcctggaaagttagatttaggtgaaagaaccttaaattacagtgaagatatctgcaaggaaatatttcctttcaaaaacacttgaatgtcttccatctaacacacaaactatgtcttacttggacagcatccaaatcccttcctggaagatagactttgccaggggagaaattaagatttccccacaacctgtttcagttgcaaaatctttgttaaagcttgatttaagcgggatcgaaaagaaagaatctaagattccggaaacatatgcttcaggatcaaaataatcttgctgtgtccggtttttctaattatgttatgtttattttctttctttacttataattatttctctgttttgtcatttcttttaagttcctcctgtttaatagaaaccataaaacaaaaaataaaataaaaataaaattaaaaatgaaacaaaaatcaaaaatgaaacaaaaataaaaaataaaaaatgaaataaaaacaacaaaaaaattaaaaaacaaaaacccaaaaaagatcccgaatgggacaatcttggccaaatttgggttttgttttgtttttgttttttgttttttgtttttatttttattttatttatttattttattttatttttgttttttattttttattttgttttttattttatgttttttcttgtttttgttattttgtttatttattaagcataacacacagaaagcaaactttaattaaacacacttattttaaatttaacacactaagcaagcacaagcaataaagataaagaaagctttatatatttgtagacttttccataatttaacttacagctgatttyaagcaagttctgcgagttttgcctgttttttaaccccgaacatttcatagaacttgttaagagtttcactgtaatgttccatagcaatacttcctttagcattaggattgctggagctgagtatagcagcatactcttttcctttcttcacctgatcttcattcatttcaaatgctttgcttttcagcacagtgcaaacttttcctaaggcttctctggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgtatgtaattcaaggtgcgaaagtgcaactctgtattccgcagtcgtttcttagggttttaatgtgatgatttgtaagactgagtgttaaggtttgaataaaattgacacaattgctct

SEQ ID NO: 331 - DNA, 2954 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttggctatactgcaaaggtagggaatcttccctgtgaagaagaagagattctttctcagcatgtgtatatccctatttttgatgatattgattttagcattaatattgatgactctgttctggcactatctgtttgctcaaatacagtcaatactaacggagtgaaacatcaaggtcatttgaaagttttgtctcctgctcagctccactctattggatctaccatgaacagatctgatattacagaccgattccagcttcaagaaaaagacataattcccaatgacagatacatcgaagctgcaaacaaaggctctttgtcttgtgtcaaagagcatacctataagatcgagatgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctctgctcatgtcagcagaaaacaacatcatgcctaactctcaggcttttgtcaaagcttccactgattctcatttcaaactgagcctctggctaagggtcccaaaggttctgaagcaggtctctattcagaaattgttcaaagttgcaggagacgaaacaaataaaacattttatttgtctattgcttgcattccaaaccataacagtgttgagacagctttaaacatttctgttatttgcaagcatcagctcccaattcgcaaatgtaaagctccttttgaattatcaatgatgttttctgatttaaaggagccttacaacattgttcatgatccttcatatcctcagagaattgttcatgctctgcttgaaactcacacatcttttgcacaagttctttgcaacaacttacaagaagatgtgatcatctacactttgaacaactatgagctaactcctggaaagttagatttaggtgaaagaaccttaaattacagtgaagatatctgcaaaaggaaatatttcctttcaaaaacacttgaatgtcttccatctaacacacaaactatgtcttacttggacagcatccaaatcccttcctggaagatagactttgccaggggagaaattaagatttccccacaacctgtttcagttgcaaaatctttgttaaagcttgatttaagcgggatcaaaaagaaagaatctaagatcccggaaacatatgcttcaggatcaaaataatcttgctgtttccggtttttctaattatgttatgtttattttctttctttacttataattatttctctgttttgtcatttcttttaagttcctcctgtttaatagaaaccataaacaaaaaataaaataaaaataaaatcaaaaatgaaacaaaaatcaaaaaatgaaacaaaaataaaaaataaaaaatgaaataaaaacaacaaaaaattaaaaacaaaaacccaaaaaagatcccgaaagggacaatcttggccaaatttgggttttgttttgtttttgttttttgttttttgtttttatttttatttcatttatttattttattttatttttattttttattttgttttttattttatgttttttgttgtttttgttattttatttatttattaagcacaacacacagaaagcaaactttaattaaacacacttattttaaatttaacacactaagcaagcacaagcaataaagataaagaaagctttatatatttgtagacttttccataatttaacttacagctgattttaagcaagttctgcgagttttgcctgttttttaaccccgaacatttcatagaacttgttaagagtttcactgtaatgttccatagcaatacttcctttagcattaggattgctggagctgagtatagcagcatactcttttcctttcttcacctgatcttcattcatttcaaatgctttgcttttcagcacagtgcaaacttttcctaaggcttctctggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgtatgtaattcaaggtgcgaaagtgcaactctgtattccgcagtcgtttcttaggattttaatgtgatgatttgtaagactgagtgttaaggtttgaataaaattgacacaattgctct

SEQ ID NO: 332 - DNA, 2930 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttggctatactgcaaaggtagggaatcttccctgtgaagaagaagagattctttctcagcatgtgtatatccctatttttgatgatattgattttagcattaatattgatgactctgttctggcactatctgtttgctcaaatacagtcaatactaacggagtgaaacatcaaggtcatttgaaagttttgtctcctgctcagctccactctattggatctaccatgaacagatctgatattacagaccgattccagcttcaagaaaaagacataattcccaatgacagatacatcgaagctgcaaacaaaggctctttgtcttgtgtcaaagagcatacctataagatcgagatgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctctgctcatgtcagcagaaaacaactcaaagcttccactgattctcatttcaaactgagcctctggctaagggtcccaaaggttctgaagcaggtctctattcagaaattgttcaaagttgcaggagacgaaacaaataaaacattttatttgtctattgcttgcattccaaaccataacagtgttgagacagctttaaacatttctgttatttgcaagcatcagctcccaattcgcaaatgtaaagctccttttgaattatcaatgatgttttctgatttaaaggagccttacaacattgttcatgatccttcatatcctcagagaattgttcatgctctgcttgaaactcacacatcttttgcacaagttctttgcaacaacttacaagaagatgtgatcatctacactttgaacaactatgagctaactcctggaaagttagatttaggtgaaagaaccttaaattacagtgaagatatctgcaaaaggaaatatttcctttcaaaaacacttgaatgtcttccatctaacacacaaactatgtcttacttggacagcatccaaatcccttcctggaagatagactttgccaggggagaaattaagatttccccacaacctgtttcagttgcaaaatctttgttaaagcttgatttaagcgggatcaaaaagaaagaatctaagatcccggaaacatatgcttcaggatcaaaataatcttgctgtttccggtttttctaattatgttatgtttattttctttctttacttataattatttctctgttttgtcatttcttttaagttcctcctgtttaatagaaaccataaacaaaaaataaaataaaaataaaatcaaaaatgaaacaaaaatcaaaaaatgaaacaaaaataaaaaataaaaaatgaaataaaaacaacaaaaaaattaaaaacaaaaacccaaaaaagatcccgaaagggacaatcttggccaaatttgggttttgttttgtttttgttttttgttttttgtttttatttttattttatttatttattttattttatttttattttttattttgttttttattttatgttttttgttgtttttgttattttatttatttattaagcacaacacacagaaagcaaactttaattaaacacacttattttaaatttaacacactaagcaagcacaagcaataaagataaagaaagctttatatatttgtagacttttccataatttaacttacagctgattttaagcaagttctgcgagttttgcctgttttttaaccccgaacatttcatagaacttgttaagagtttcactgtaatgttccatagcaatacttcctttagcattaggattgctggagctgagtatagcagcatactcttttcctttcttcacctgatcttcattcatttcaaatgctttgcttttcagcacagtgcaaacttttcctaaggcttctctggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgtatgtaattcaaggtgcgaaagtgcaactctgtattccgcagtcgtttcttaggattttaatgtgatgatttgtaagactgagtgttaaggtttgaataaaattgacacaattgctct

SEQ ID NO: 333 - DNA, 2927 bp, Tomato spotted wilt virus
agagcaattgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccaactgtattctgattcaagaagcaaaagtagctttggctatactgcaaaagtaggggatcttccttgtgaagaagaagagattctttctcagcatgtgtgtatccctatttttgatgatattgattttagcatcaatattgatgactctgttctggcattatctgtttgctcaaatacagtcaatgctaatggagtgaaacatcaaggtcatttgaaggttttgtctcctgctcagctccactctattggatctatcatgaacagatctgatattacggatcgattccagctccaagaaaaagatataattcccaatgacagatacattgaagctgcaaacaaaggctctttgtcttgtgtcaaagagcatacctataagatcgagatgtgctataatcaagctttaggcaaagtgaatgttctatctcctaatagaaatgtccatgaatggctgtacagtttcaagccaaatttcaatcaagttgaaagcaacaacagaactgtgaattctcttgcagtgaaatctctgctcatgtcagcagaaaacaacatcatgcctaactctcaagcttttgtcaaagcttccactgattctcatttcaggctgagcctctggctaagggttccaaaggttttgaagcagatttccattcagaaattgttcaaggttgcaggagatgaaacaaataaaacattttatttatctattgcctgcattccaaactataacagtgttgagacagctttaaacattactgttatttgcaaacatcagctcccaattcgtaaatttaaagctccttttgaattatcaatgatgttttctgatttaaaggagccttacaacattgttcatgatccttcatatccccaaaggattgttcatgctctgcttgaaactcacacatcttttgcacaagttctttgcaacaacttgcaagaagatgtgatcatctacaccttgaacaaccatgagctaactcctggaaagttagatttaggtgaaaaaaccttgaattacagtgaagatgcctacaaaaggaaatatttcctttcaaaaacacttgaatgtcttccatctaacacacaaactatgtcttatttagacagcatccaaatcccttcctggaagatagactttgccaggggagaaattaaaatttctccgcaatctatttcagttgcaaaatctttgttaaagcttgatttaagcgggatcaaaaagaaagaatctaagattaaggaagcacatgcttcaggatcaaaatgatcttgctgtgtccagctttttctaattatgttatgtttattttcctcctttacttataattatttctctgtttgtcatttctttcaaattcctcctgcctagtagaaaccataaaaacaaaaataaaaataaaataaaatcaaaataaaataaaaatcaaaaaatgaaataaaacaacaaaaaattaaaaaacaaaaaaccaaaaaagatcccgaaagggacaattttggccaaatttgggttttgtttttgttttttgttttttgttttttgttttttatttttattttttattttttattttactttattttatttttatttgtttttattttatgtttttttgttggttttttattatgttatttattaagcacaacacacagaaagcaaactttaattaaacacacttatttaaaatttaacacactaagcaagcacaagcaataaagataaagaaagctttatatatttataggttttttataatttaacttacagctgcttttaagcaagttctgcgagttttgcctgttttttaaccccaaacatttcatagaacttgttaagagtttcactgtaatgttccatagcaatacttcctttagcattaggattgctggagctaagtatagcagcatactctttccccttcttcacctgatcttcattcatttcaaatgctttgcttttcagcacagtgcaaactttccctaaggcttccctggtgtcatacttctttgggtcgatcccaaggtccttgtattttgcatcctgatatatagccaagacaacactgatcatctcaaagctatcgactgaagcaataagaggtaagctacctcccagcattatggcaagcctcacagactttgcatcatcaagaggtaatccataggcttgaatcaaagggtgggaagcaatcttagatttgatagtattgagattctcggaattcccagtttcctcaacaagcctgaccctgatcaagctatcaagccttctgaaggtcatgtcagtggctccaatcctgtctgaagttttctttatggtaattttaccaaaagtaaaatcactttgcttaataaccttcattatgctctgacgattcttcaggaatgtcagacatgaaataacactcatctttttgatctggtcaaggttttccagacaaaaagtcttgaagttgaatgctaccagattctgatcttcctcaaactcaaggtctttgccttgtgtcaacaaagcaacaatgctttccttagtgagcttaaccttagacatgatgatcgtagaagttgttatatgctttgaccgtatgtaactcaaggtgcaaaagtacaactctgtatcccgcagtcgtttcttagggttttaatgtgatgatttgtaagactgagtgttaaggtttgaataaaattgacacaattgctct

SEQ ID NO: 334 - DNA, 2926 bp, Tomato spotted wilt virus
agagcaattgtgtcagaattttgttcataatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccagctgtattctgattcaagaagcaaaagtagctttggctatactgcaaaggtaggggatcttccctgtgaagaagaagagattctttctcagcatgtgtatatccctatttttgatgatattgattttagcatcaatattgataactctgttctggcactatctgtttgctcaaatacagtcaatgctaacggagtgaaacatcaaggtcatttgaaggttttgtctcctgcccagctccactctattgaatctatcatgaacagatctgatattacagaccgattccagctccaagaaaaagacataattcccaatgacaaatacattgaagctgcaaacaaaggctctttgtcttgtgtcaaagagcatacctataagatcgagatgtgctataatcaggctttaggcaaagtgaatgttctatctcctaacagaaatgtccatgaatggctgtacagtttcaagccaaatttcaatcaagttgaaagcaacaacagaactgtaaattctcttgcagtgaaatctctgctcatgtcagcagaaaacaacatcatgcctaactctcaagcttttgtcaaagcttccactgattctcatttcaagctgagcctctggctaagggttccaaatgttttgaagcaggtttccattcagaaattgttcaaggttgcaggagatgaaacaaacaaaacattttatttatctattgcctgcattccaaaccataacagtgttgagacagctttaaacattactgttatttgcaagcatcagctcccaattcgcaaatgcaaagctccttttgaattatcaatgatgttttctgatttaaaggagccttacaacattgttcatgacccttcatacccccaaaggatcgttcatgctctgctcgaaactcacacatcttttgcacaagttctttgcaacaacttgcaagaagatgtaatcatctacactttgaacaaccttgagctaactcctggaaagttagatttaggtgaaagaaccttgaattacagtgaagatgcctacaagaggaaatatttcctttcaaaaacacttgaatgtcttccatctaacacacaaactatgtcttacttaaacagcatccaaatcccttcatggaagatagactttgccagaggagaaattaaaatttctccacaatctatttcagttgcaaaatctttgttaaagcttgatttaagcgggatcaaaaagaaagaatctaaggttaaggaagcgtatgcttcaggatcaaaataatcttgctttgtccagctttttctaattatgttatgtttattttctttctttacttataattatttctctgtttgtcatctctttcaaattcctcctgtctagtagaaaccataaaaacaaaaaataaaaatgaaaataaaattaaaataaaataaaatcaaaaaatgaaataaaaacaacaaaaaattaaaaaacaaaaaaccaaaaaagatcccgaaagggacaatttggccaaatttgggttttgtttttgttttttgttttttgttttttattttttattttatttttattttattttatttttattttatttttattttatttattttttgttttcgttgtttttgttattttattatttattaagcacaacacacagaaagcaaactttaattaaacacacttatttaaaatttaacacactaagcaagcacaagcaataaagataaagaaagctttatatatttataggcttttttataatttaacttacagcttctttcaagcaagttctgcgagttttgcctgctttttaaccccgaacatttcatagaacttgttaagagtttcactgtaatgttccatagcaacactccctttagcattaggattgctggagctaagtatagcagcatactctttccccttcttcacctgatcttcattcatttcaaatgctttgcttttcagcacagtgcaaacttttcctaaggcttccttggtgtcatacttctttgggtcgatcccgaggtccttgtattttgcatcctgatatatagccaagacaacactgatcatctcaaagctatcaactgaagcaataagaggtaagctacctcccagcattatggcaagtctcacagactttgcatcatcgagaggtaatccataggcttgaatcaaagggtgggaagcaatcttagatttgatagtattgagattctcagaattcccagtttcttcaacaagcctgaccctgatcaagctatcaagccttctgaaggtcatgtcagtgcctccaatcctgtctgaagttttctttatggtaattttaccaaaagtaaaatcgctttgcttaataaccttcattatgctctgacgattctttaggaatgtcagacatgaaataacgctcatcttcttgatctggtcgatgttttccagacaaaaagtcttgaagttgaatgctaccagattctgatcttcctcaaactcaaggtctttgccttgtgtcaacaaagcaacaatgctttccttagtgagcttaaccttagacatgatgatcgtaaaagttgttatatgctttgaccgtatgtaactcaaggtgcgaaagtgcaactctgtatcccgcagtcgtttcttaggttcttaatgtgatgatttgtaagactgagtgttaaggtatgaacacaaaattgacacgattgctct

SEQ ID NO: 335 - DNA, 2926 bp, Tomato spotted wilt virus
agagcaattgtgtcagaattttgttcataatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggtactggttctcaactagttcagacccagctgtattctgattcaagaagcaaaagtagctttggctatactgcaaaggtaggggatcttccctgtgaagaagaagagattctttctcagcatgtgtatatccctatttttgatgatattgattttagcatcaatattgataactctgttctggcactatctgtttgctcaaatacagtcaatgctaacggagtgaaacatcaaggtcatttgaaggttttgtctcctgcccagctccactctattgaatctatcatgaacagatctgatattacagaccgattccagctccaagaaaaagacataattcccaatgacaaatacattgaagctgcaaacaaaggctctttgtcttgtgtcaaagagcatacctataagatcgagatatgctataatcaggctttaggcaaagtgaatgttctatctcctaacagaaatgtccatgaatggctgtacagtttcaagccaaatttcaatcaagttgaaagcaacaacagaactgtaaattctcttgcagtgaaatctctgctcatgtcagcagaaaacaacatcatgcctaactctcaagcttttgtcaaagcttccactgattctcatttcaagctgagcctctggctaagggttccaaaggttttgaagcaggtttccattcagaaattgttcaaggttgcaggagatgaaacaaacaaaacattttatttatctattgcctgcattccaaaccataacagtgttgagacagctttaaacattactgttatttgcaagcatcagctcccaattcgcaaatgcaaagctccttttgaattatcaatgatgttttctgatttaaaggagccttacaacattgttcatgacccttcatacccccaaaggatcgttcatgctctgctcgaaactcacacatcttttgcacaagttctttgcaacaacttgcaagaagatgtaatcatctacactttgaacaaccttgagctaactcctggaaagttagatttaggtgaaagaaccttgaattacagtgaagatgcctacaagaggaaatatttcctttcaaaaacacttgaatgtcttccatctaacacacaaactatgtcttacttaaacagcatccaaatcccttcatggaagatagactttgccagaggagaaattaaaatttctccacaatctatttcagttgcaaaatctttgttaaagcttgatttaagcgggatcaaaaagaaagaatctaaggttaaggaagcgtatgcttcaggatcaaaataatcttgctttgtccagctttttctaattatgttatgtttattttctttctttacttataattatttctctgtttgtcatctctttcaaattcctcctgtctagtagaaaccataaaaacaaaaaataaaaatgaaaataaaattaaaataaaataaaatcaaaaaatgaaataaaaacaacaaaaaattaaaaaacaaaaaaccaaaaaagatcccgaaagggacaatttggccaaatttgggttttgtttttgttttttgttttttgttttttattttttattttatttttattttattttatttttattttatttttattttatttattttttgttttcgttgtttttgttattttattatttattaagcacaacacacagaaagcaaactttaattaaacacacttatttaaaatttaacacactaagcaagcacaagcaataaagataaagaaagctttatatatttataggcttttttataatttaacttacagcttctttcaagcaagttctgcgagttttgcctgctttttaaccccgaacatttcatagaacttgttaagagtttcactgtaatgttccatagcaacactccctttagcattaggattgctggagctaagtatagcagcatactctttccccttcttcacctgatcttcattcatttcaaatgctttgcttttcagcacagtgcaaacttttcctaaggcttccttggtgtcatacttctttgggtcgatcccgaggtccttgtattttgcatcctgatatatagccaagacaacactgatcatctcaaagctatcaactgaagcaataagaggtaagctacctcccagcattatggcaagtctcacagactttgcatcatcgagaggtaatccataggcttgaatcaaagggtgggaagcaatcttagatttgatagtattgagattctcagaattcccagtttcttcaacaagcctgaccctgatcaagctatcaagccttctgaaggtcatgtcagtgcctccaatcctgtctgaagttttctttatggtaattttaccaaaagtaaaatcgctttgcttaataaccttcattatgctctgacgattctttaggaatgtcagacatgaaataacgctcatcttcttgatctggtcgatgttttccagacaaaaagtcttgaagttgaatgctaccagattctgatcttcctcaaactcaaggtctttgccttgtgtcaacaaagcaacaatgctttccttagtgagcttaaccttagacatgatgatcgtaaaagttgttatatgctttgaccgtatgtaactcaaggtgcgaaagtgcaactctgtatcccgcagtcgtttcttaggttcttaatgtgatgatttgtaagactgagtgttaaggtatgaacacaaaattgacacgattgctct

SEQ ID NO: 336 - DNA, 8911 bp, Groundnut bud necrosis virus
agagcaatcgtgcaacaataagaatatcagtaatgaacatacaaactataaacaatttcttagatacttcaggcgaaattaccgtgtatctacgaagtataaaagatgaaatcatgtctatgtcgaacatcgtggaaagagggtatcctgaagggaaaggagtaattgaatctggtctcaattcaataatgtcaatgaattacgttctagacagaattgaagatatgaaatccagataccaccaaagctcttcttcaatcgatcaaaaagagatggaaaaagagatttacctttttcttgacaaatataaggaactggagctgatgagacacgatctatttggtgtccttgctgggagaagattgcattttgcacccaagcatagatccgatgttttcttaaaggactgtcttatgtcttatatagaattctgcaacacctccacaaacattattaaccagatagttgacatagatggattgaaagagaagttggtcttccaacatctcactccagacaactacacaatatacaaagaaactaaaggtgaaaaagcatgcttgatgatatatgattggaaagtttcagtagatgctgtttcagaagctaaaacatctgagaactactacacaagtgtgtggaaaacattcaaagatatcaccatagatggtcaaccctttttggaaaggcatcctatattcataacgatcgttgtattgaacccgagtgggaatatgccaatagttgcaaccaccagcagagtcattcaagaatttagaaattccccttataagactttcaatgatcggaagaaggcagcttctgcagcaaagcttatttctgtaaattccctgggacagcttattggcctaggcgcagattgctttagacgattttactcagaaacgcaaacattcaagaattctctcttaactaaggtaggggagtatatgaacagatcttcagaagttttcttcagtcattggtcatatgagtataggaaaacaaatttatcaaataatcaaatcagccaagacataattgatctaattgatgcaatgcctaacaacacagtgaacaaagagacacttgtgcatttcttatttggcaattatttgtattttaaagaaaccatgagtgatctccatctcaaagataggtttgaagggtacaaagcacattgtgaaatgatgaaagttaaacctataaaaacagaagaaaagcttaaagagtacttagaagaaaatgaattgatatttgaaaatttgtatgaggatcatttggagaagataaaatcagatgtgttatataggaaagccaaagaagtggaaatagaaagcattgaacgtgctttcaacattaatgctgaggaatatcaaaaagaataccctggatgttttacaaacgatcttcaagagaccaagacaaacttttcaatctgttggtcacctatgacagaagaattagaaatgaatgagcgaaattataataatgctatcatacagtctttcagagatgcttttgatgaacaacctaaattaattcatcacaaatcatatggaggtagcaagatggatattcacttttccatgacccttttcaatctagttagaacttgtctggttgacttaagcacagacacaacaggtcactcaaaggccactttggaagatgttgttgatgttaaagatggtagcattcaagttaaacgaacagaaacctcccaaaaatggaaagatatagggaaagtcaagaccagaaatggtaatgagtttactttatcaccttctgctgataatgaagcaagaaaacatttctttaagggcttaagcttaatgtacattgatatggggaaaaagaagaaaatagacataaaaaatgagctcaagagcaaaatacaagaatctatagcaaaacagaaagatgaagactcgaatggacctagtggagaatatgatgtgtctaaagctaatatacctttccaaacgagcattaaaggagtgacgcataataaaaaacttatcaggcatgataaccctgatgtgaagtatcattgtgaatcaatgatagaagccatgtatgttctttatggaatggatgagagaaagaataaaccaagtaagataagctctgtttatgatgaatattgttccaaccctgcttcactctttgctaaaggcaatttaatagaatcagaaatgacaattgctaagaatatccatgaagtggccaaagaattatctgtgtacacatatagtgaagacatgatgcagatggcaaagggtttaatggtagctgacagatttatgaagaaaacagatttcaagatcctaacttgtgctaatacaagcatgatatgcctagcattcaaaggtgatggcataaacacaggaaaatcaggtgtaccatatatcactttgcataaagtagaaaaaggtatacagcctttctttgcgtctttgtatacaaaagaattaatcacttcttttaaagcagggaattacttcatcaacatcatgagacctcagagattgaatcaagttcgattactaagcctattcaaggctcctagtaaagtacctatactcttttcgcaatactctttgctgagcacagaaataaagaaatggctaaaccaatcatctgtggatgtgttcacatgccctgagaacaagatacaatatcttcaaaagatattgttttcttctgtgatcataggtactgtgaccaagctcagcagaatggggatatttgatttcatgaggtatgctggctttttgccattatccgattactctaacattaaggaatacatagcagaaaaatttgatcctgacattactaatgtcattgactgtttctttgtttcaggcataaagaaccttcttttaaagatggaaggaattaacttaagtaatagtataaaacctttgaccattgatcaagaaaacgatatgtctggaggtatatcagacttagatattgtctgtcctattacaggttccacattgaagaccatagaatgtttatataacaatgtctatctagcaatctatatgatgcctaaatctttgcatactcatgttcataacctcacaacacttttaagtgtgcctgctgaatgggaaattaaatttagggaaaagatgggatttatgataggtgatgagattaaaccaaaaaaagaaatgttcaatgattctggtccattttccattaatggagttctcaatgtgaaagctttatttgactactatagaaaaaatattatcaatgttggtgcttgtaggtcaaatattgaagacaaagaagatttcttatctgcaccatacaagataaaaactttgacatcttccaagaaatgttcaaaagcagacattataaaaagttctgagataatttcagctttaaaatcaacatttggaaagcatccggatgatattaaagggtctgacttatacatattgaaaggagtcttaaaatgttttgtagaagacagagagtcattattgaattttatggaaatggaaaatctagaagaatcaaagtatctgcactttttttctaacatgatgtcaggaagtaacaaggtgctcatgaaaacaaatcaggacaaattctattacaaaagtcatcctttaacagtagaaacattcatgaaagtaagatatggttattttaaaacaactccggtgctgaagtcaaagaaagttagcgaagaattatatgacttgatcaaagaattcaataagataacagaaattgatctggaatctctagaaaaattaggtcgtggattgaaaggtaatagagtgacatttatccaattgctagagtttatcttgatgaaatcaagaactaatgcagggaacacagatttccttgtttctgtgttcgaaaagatgcagaggacaaaaatggatagagagatttatctcatgagcatgaaaacaaaaatgatgttatattttatagaacatacatataagcatgtagcacaatctgatccatctgaagcaatctcaatctctggagattacaagataaagaatttggcatccttatcatatgacactataaccaattacaatactgctctccaaaaaaatctagaatgtaaaatggctttcttgtcagccgaccaatcaaaatggtcagcttcagatttaacttacaaatatatactggctgtcatgatgaaccctattttaacaacaggtgaaatcaacctaatgtgtgaatgcataatgatgtatgtgaaattgaaaagagtttgcattcccactgacatttttctaaatctaaagaggcgtcaaacagaatatggatcctatggaactgctctgtctgttttggctgataacttagagacaaacacattcccagtgtctatgaattggcttcaagggaatttaaactacctgtcatctgtctatcattcttgtgccatgatgggttatgtaaaagctatgcagaaaatgaaagattatgattttacaataagatggatggtgcattctgatgataatgcaacatccattgtagttaggggagacataaagaaactcctttccagcttcaattgttctagcttatcagagttactattcagaagcatccagtctcattttaagagttactgtatcacattaaatcctaaaaagagttatgcatctgaatctgaggtggagtttatctctgaaagaatcattaatggagcagttatacctttatactgtaggcatttagctaactgtagcactgaaagctcacataatagttattttgatgacctaatgtctctttctatccacataaccatgcttttgagaaaaggatgtcctaatgaattaataccatttgcttatgcagcaatacaaattcaatcacttagcatatactctatgcttccaggtgaggaaaatgacataacttctattgttaaagatattaactttcctttaaagaagagggaaatccctatatgtgctggtggttggatgcatgcccctattgaactactgtctatcctgggtccgtcttcaaatgatcagttaatatattacaaaattatattagatttcttcaatgtgaaggattttagcagtctcaagaaaaatgttaactctctaggttatatagatctaaggatcaatgaattatttaaaaggataaaatatcaaaacataatagaagcagacaaaaagatgatatgcatggtgaatctgtttaaaactagtttgatgtctgaagattgtgatagtctaaatgtagggatgaagttccagtctatgataacacaaatcataaagttaccaagctttgttagtgaaggatcattactcaagaattctagctttcaagatttctgtaagctattccctaatttgagaaaaaatacagatataattgatgctttaaagcctgttagtctggatgaaagagaccttggagaaataaatgaatctaaatttctatcacaaatacaattggaagaattaagcaggcacatgtcttctcatccagaatcatttctgattgcaccaatgaatgataaagattatatcttgacaaatctttatgcatacagcagtgtaagcaaaagaaaccaaatgtcaagtcaatcaacagaaaaactggcattagataggattttgagatctaaggctaaaacatttttagatccaaactcaaaaattatggtttcatataaagacaatatgtctatgaaaatgaaagagataatgagctcagaaggaaatgacttcaagataataaatacaatatcaggtttgatggtgagggatatgaattttgaaatggttgtatcactcatggagaacactgttgccaacgcctctattcctaaagctaattacaatttcagatggtttattacagagaaagtccctagtgtaattgaaggatcaccaggcttaattgtaatgtcagcagtttatggcatggattacctaatcgaattaggtctaaaaaagcttcccttaactgaaacttccatttctatactgcatgatatctttgggaacagaaagacatttgatgatgttaaagagtgcattcaaaatgtcagcaaacagtataaaacagaagaatttcaaaatgctgacattttgaagagatatgttctgagcataaattacatgattcagtctcaaaacaaacttctttccattaatacatgtttctctagaaagaatttccctttttattctaagtacaatttgggtaaaacttttataacaaacaccttagctatatggagcacaatatatagtcgtctgacaaatataaatttttacactaatctgaattttgtaatagataggagttcaaggcttattatatcattgcagagagatatgaatctagaaaaatcaattgattgttgtgcatatgtgtctgataggttgcaaagtctgttcccagccatgactatagaatcaatcaagcaagtgttgtgtagactgaatttcaatggtgtagatcttatgaagaaaatgaagtctgaaatttcagaagtgaaaagagccataaataatataaagacatcaactcatgttactctctcattcagacctcaaatgattgcaatgagtaagcatgcagcatggctatacaattttgattatatcaatgaaaaagagttcaaatttgtgatagaccaaatcaggcaaagtgaagtccattacatcaaaacagatgaacaagatgtgagaggttactatgtttcaggccatgcatataaaattggaataaaaactcaatataactatgggcaattggccatgtcaaaccaagatatatcaattcatttgcactcgccgtatgaatatcagagagaagatgatgggaagatatgggaagtacatgttagatcagcatataaattgcttcaaaaactacttttggacaaacagagtgctattaaaaccttcttgaatgtcagggctgatctgatgccaaatcaattctgcatccatgaaagctcaaacaaaacacttttaatacttatcaatgatacaactagaccaatcacattagaaaaaattaagtttaaaggtgatataaaatacatcccttcttctgactttgcttggaatctaatgaacaatcaatcaaaatacaggttaaggaaagcagaaacaggagaatgttatacagaactatacaagatgatagacaatgatgacagtttgatggacactattcttgccaacctaaaaaagagcttagagtatggtaatgaaatggaaaacttgatagaacaatcaatacaaggaatagatgatagtgatgctatagaatgtattaaggattcggtggaccagattcataaattggctgtagaaggattagaaacatgcaagacatcggaagagtttgaaaattatttgaagagagttgactttcaatctacggtggactttcacaaaggtctattggaccagattgtcgaagaaaaatataaatcatctgacagggtggatgaagctgtagaaaaactaactagatggacaaatagcttatcaacatttaaagatgtctgcacaatgttgaagttctcaatgatcaatgattcaaaagggattaaaacatataaagccaacggagctgatttccactcactatctgcaagtgaggtcatgacatcccaaggatttgacttatttgaacttttaaagttgatcaaagcttgcgaggcatgccatacaagtaattcagttttaaacttaattgctttccaaaatataaaaaacaaaacatttatacctggatttaagaggagcctgcctaacactgttcattttgactatgagatgaaattgaataacgaggtaatgagcaattttatgaatataaacatatccctccaagatattaaaatatcagaaagagtcatacaggtgttagaagcacatgggtttagtgtgactgggcaaaacttgaagttggatgaagtaaatttggaattgaacccagtggaaattatagatgattcttctacttatgatcagattgcaaggcaaatgagattaactaaaaagaagagctcatatctaatacctgcgaatactttattactaggtgaattgatgaaattcttgatgttatgcattaaaggagaagaacatgatataatgaagctcctgagaagtcactttgcaatgaggccagtgagggaaaatagattgctttgtgttcaagatgctgtcatgacttgcagaataagtggattcatacaaagacactttctcaatgacaaaaaagagatagtgttgttaggtgtagcagatagcttggaaaatttcatctctctagctactccaaattatgcagtacaagagccatttaaagcagaagctttaatcaaaaaagctctgctagaagtatatgactctggaaaacataaaatattgaaaaatatcagaagttacatagttgctgatgtagaattcttgacagaaaagtgtttgtattcgaacataactaacgaagaaataagcagcatgatatttaacgctgttagcaagattgacttagaattggcaaacttaaagccaaaaaagagaaagaagagattagacctacatgatgtgtttaacaaatttctgggatcaggtgctacttcttcagaacaagaataaaagggagataatctatgggcgagagaaaaggtataagtcatagaataagtagtttaagttctagatcaggaaaagagcataatgtcaaaatttataatttcggagaaaaggataaaaacaaaacaatttggcctaaaatgcaatagagttataaaacctaaaccagacagtagggtctaaaatagtatttcttaataaaattgagactgagtttagaatactttaatttgttgctcgattgctct

SEQ ID NO: 337 - DNA, 8911 bp, Groundnut bud necrosis virus; identical to SEQ ID NO: 336

SEQ ID NO: 338 - DNA, 4801 bp, Groundnut bud necrosis virus
agagcaatcggtgcgccaattactagataaaatcatcaaatactaaacaagaaataatgtctcgcttttctaacgttttagaatctttccgtccttcaaacagctcaaacaaagagctagtgcctgcagttaaaaaggaaaacaacagaagcattttggcaagaaatgtttcaaagaaagatgttgacagcgctataatgaacaaagcaaaaacattaaatgggaaacagtatgtttctagtggagattccagtgtcctgggcacttactctagcgagtcagctgtggaagccacctctgatgatattttgtccaggcttgttgttgagcaaagtactcatctgagtaactggaaaaatgattcacttgtgggcaatgggaatgacaaagttagctttaccataagcataatgcctacatggaacagcaacaggaggtatatgcatatatcaaggcttataatctgggttgttccaactatccctgattcaaagaacaatgtcaaagcctccttaattgacccaaacaaaatgactaaagaggagaagataatcatcagcagacaagcctcattaaaggatcctatgtgtttcatttttcatctaaattggtcattcccaaaagagagaaatactccaaaacaatgcatgcagctcaatttaactagtgatgaaaaatatgccaaaggagtcagctttgcttcagtcatgtattcatgggtcaagaacttctgcgatactcctatagctgccgaaaataacacatgtgatgtagttcctattaacagagccaaggtcattcaatctgctgctctaattgaagcatgcaaattaatgatacctaaaggaaccggtgggaaacagatatccaatcaaattaagagtctgcagaaagctgctgaaaggctagcattagaagctgaaaatgatgatgagagcctagatgttgatattgagatggataatcttcttgaaatataatattgtttggttgtctaccttttgtgcttaagttgattaaatgtttgtttatgtttgaatacctaaatattgcttaaatctaaatctgtgtgtgttctacaaatagacaataaaaataaaattcaagtcaagttcttgtttgtttgcatcaataaaatgataaaagaaaaatctgcatttatctatgtgtgtgtatcagtttattgtaaaacaagcaaaacaaaaaagaaaataaacaaaaacaaaaacaaaacagaaaatgagaaaaaccaaaataaaaacaaatatatataactaaataaggcttaggccaagtttggcttttcagcctttttttggattttattcattttatattgtttttgggttttataaagatttactgtacaaatatttgcttaagcattattaaatatctagagaaaagtcatagcccttaggaggagatttcctctttctggtttggtctattcctgtataattagccaagaggacacttgattcaacagattctatagcgtcttctaacttttgccttctcttgtccacgtaatatgttctggatagtttgaagatgctacttacaatatataaaccaacacaagcagctacgataaccaatataattctaactagatcaaagaagcttccaaagaaggaagctatccagttaaaaggtgctttaatccagtcccataagctagaaatagaagtatcagagtggtgcttattctcatcgtgtgcacttttgtcatcaaaatgtattatagtatcttggtcaacttgagtaaattcatccacctgtatatctactgtaagctcttcctggtcttcagggatcaatttcaatgatttgtctgttatctcttcagaacagtaagctttgatggatttctcatttggacctagaaatgttcctaattgatcagatttgaatgaacaagtatccatcatcaaccttgctgagaatgtagtatcagacgtgtaagttatattgcaatcaatacctacagcacactgcgaacagcctgaacagatcattttagcttctgaaatgataggttttgttgggatctttttgaacatttctttaggcatatcaacaaccattttgagcttaccaactaagaaatccttctccatgtatagcttgttgctgttctcatccaaatgagacacatcttttgatggagataaaacataaattgcactgtatgtgtaaagtccacattgtttaatattaactttcttgtcacctactgcactacagctccatgtaaaatcattttgagataaagttgctggaacagataaaggaattccatctatagtgatttgaggatgtccaaatgatgaccctgcaaaatcccctaaatcggcaatgttccctgtgagaattttttgttgtttggttacagcaaataacttatctgtgctcatgtaatcattgtgtaaatcaattgacatgtcaagttgataataatctgtttgtatgggagatctgtctgaatgctttttacaagaatatccatctaatgattttacacaaacttctgcagtgacatggctttcaacaacttgatagatattaaccaaacttgatagatcataaatgtttgtacagtgaccacatattgagccttcatttattgccagacaaccgagttcttcacaaccccaccaagaggttggagtgacacagaaatcaagtactcctactttaggtttctgttttatacaatctgcacacttacctgtgcatgttactagataatcagatactgttgtatcaatttttgcagtagaatatttatacctcacatcatactcaacaccaacactcttgatatatatcataaattccataggagaatgtgttgcatcatcgttaagtagatagactgaacccgtgttagacttaatatccatctctaaaagatatctatatttcccatctacttcagtggaaaacactagagattgcctaggtaataagttctcaggaggtatgtcgtctacctttaggcttttataaaatttatattctttggcagattcttcttctaagatctttgattcagtagggctgtccatatacccttccctcaatctgttagctatctttaagctggtcaagttgcctttgaaagactgccctttgtacaatttgttgaatttggtatctggtatgttttttatggatgataatgaattacaaccattcctgcaagcaaataagttttgagcttgattgttgctgaccatacacagatctgaacctaaaacacagtcattaagtgatgttgctctagacatcggtacaccagatctgtaaactgtctcagtgattacatttcctatggagcattcacatgtttcatatccgttatctgtcatcccgaatttgtctgttgtcaaagaatctaagtttaagttataatagcacttttccacacatatattgggttgcttgagtgcaatactagatggtatgtatgaaataaggattgatgctaaaatcattttagtcacaaacaccaagaaattggtactcaatttagtatttatgatgaactgaaactgttggattaaagtcagtttgcgccattcttctttgtctttagtaaaaagatagcattcatcggtatgatctttagatgctttgtcttgattacaaacacatttttctgtgcaagagtgagttaaaaacgaaaagcatccgcagatcctgcattttaatgggaaatatggccacaaccagttgagtgtccagagaattggatatgtcaaaataccgatcacatcataccagatgcttaaagcatctttagttttccagataaaccatgatatgggaaatgcaaccatcaaaaacacaaaaatccatttgaagtaagaaaagtttgtgcagaagaaaatctttttgggttcatctgaatattttgaaacacagtttctcacaggtatgtctactttagcgatcaggctagatttatcaccacaaagtaaaaaatgattgccatctagttcttcaggtttgaagtttattgttgtgtcaccagcaatagattttatattaccggatttagagcttttcacattctttatcaaaattcctatgttttcttcagaccttaatttgatttgataaggagatgacatagaaacctggttgattttgcagtcaccagacaaccttacagaaagccgagccacagtaggagatttcaagttcacttttgggtcaatgttgatcgggttgtttgatttgtcaacaaagaaaaacttagttcctatttccagcacttttttattctccaactttaggactggaacaactggaaagcttttgaattttatcttcttgaactccttttcatactgacaaatgtcaaatatattggcagagttgctgatgcaggagattatctcattaccattgtcaatctggtaatgggcattaaagtcactcacacctttaatcatgcaatgccttttctcaaagatatcacagcttagttcagagacagatgattgtgttgtgacttcatcatttctaagaatccgggacaatttcttctgtctaggctcaataatttcagttattatgttatcctcttcttcaacgaggtcttctggatcatccactttgtatctatcttggatctttctcaactggacactattatccacttgattcaagaggtatacttcagacacgaagaaaagcgaaactagacctagacagtagacaagtagatagtatttcttcattcttatgaggtatttcaagaatatttaattgttgcactgattgctct

SEQ ID NO: 339 - DNA, 4801 bp, Groundnut bud necrosis virus; identical to SEQ ID NO: 338

SEQ ID NO: 340 - DNA, 4815 bp, Groundnut bud necrosis virus
agagcaatcggtgcgtcaattactagataaaatcatcaaataataaacaagaaataatgtctcgcttttctaacgttttagaatctttccgtccttcaaacagctcaaacaaagagctagtgcctgcagttaaaaaggaaaacaacagaagcattttggcaagaaatgtttccaaaaaagatgttgacagtgctatcatgaacaaagcaaaaacattgaatgggaaacagtatgtttctagtggagattccagtgtactgggcacatactctagtgagtcagctgtggaagctacttctgatgatattctgtccaggcttgttgttgagcaaagcactcatctgagtaactggaaaaatgattcactcgtaggcaatggaaatgacaaagttagctttaccataagcataatgcctacatggaacagtaacaggaagtatatgcatatatcgaggcttataatctgggttgtgccaactatccctgattcaaaaaacaatgtcaaagcctccttaattgatccaaacaaaatgactaaagaggagaagataattatcagcagacaagcctcattaaaggatcctatgtgttttattttccatctaaattggtcattcccaaaagagagaaatactccaaaacaatgcatgcagctcaacttaaccagtgatgaaaaatatgccaaaggagtcagctttgcttcagttatgtattcatgggttaagaacttctgcgatactcctatagctgctgaaaataacacgtgtgatgtagttcccattaatagagccaaggtcattcaatctgctgctctaattgaagcatgcaaattaatgatacctaaaggaactggcgggaaacagatatccaatcaaatcaagagtctgcagaaagctgctgaaaggctagcattagaagctgaaaatgatgatgagggcctggatgtcgatattgagatggataatcttcttgaaatataatattatttggttgtctgccttttgtgcctaagttgattagatgtttgtctatgtttgaatacctaaatattgcttaaatctaaatctatgtgtgttctataaatagacaataaacaaatttaatttcaagtcaagttcttgtttgtttgcatcaataaaatgataaaaagaaaaatctgtgtgtgtctatgtgtgtgtatcagtttattgcgaaacaagcaaaaacaaaaaaagaaaaataaacaaaaactaaaacaaaacaaaaaatgagaaaaaccaaaaataaaataaaaataaatatatatagctgaataaggcctaggccaagtttggcttttcagcctttttttggtttttgttcattttatattgtttttgggtttttataaagatttattgtacaaatatttgcttaagcattattaaatatctagagaaaagtcataacctttaggaggagatttcctctttctagtttggtctattcctgtacaattagccaagagaacacttgattcaacagattctatagcatcttctaatttttgtcttcttttgtccatgtaatatgttctggatagtttgaaaatactactcacaatatataagccaacacaagcagctatgataaccaatataattctaactagatcaaagaagcttccaaagaaggaagctatccagttaaaaagtgctttaatccagtcccataagctagaaatagaagtatcagagtggtgcttattttcatcatgtgcacttttgtcatcaaaatgtgttatagtatcctggtcaacttgggtaaactcatccacctgtatatctactgtaagctcttcctggtcttcagggattaatttcaatgatttgtccgttacctcttcagaacagtatgctttaacggatttctcatttggacctaaaaatgttcctaattggtcagatttgaatgaacaagtatccatcattaaccttgctgagaatgtagtatcagacgtgtaagttatattgcaatctatacctacagcacactgcgaacaacctgaacagatcattttagcctctgaaatgataggttttgttgggatttttttgaacatttctttaggcatatcaacaaccattttgagcttaccaactaagaaatctttttccatatatagcttgttgctgttttcatctaagtgagacacatctttcgatggagataaaacataaatagcactgtatgtgtaaagtccacactgtttaatattaacttttttgtcacctactgcactacaactccatgtgaaatcattttgagacaaagttgctggaacagataaaggaattccatctatagtgatttgagggtgtccaaatgatgaccctgcaaaatcccctaaatcggcaatgttccctgtgagaattttttgttgtttggttacagcaaataacttatctgtgctcatataatcattgtgtaaatcaattgacatgtcgagttgataataatctgtttgtatgggagatctgtctgaatgcctcttgcaagaatatccatctagtgattttacgcaaacttctgcagtgacatggctttcaacaacttgatagatattaaccaaacttgatagatcataaatgtttgtgcagtgaccacatattgatccttcatttattgccagacaaccgagttcttcacaaccccaccaggaggttggtgtgacacaaaaatcgagtactccaactttaggtttctgttttatacaatccgcacacttacctgtgcatgttactagataatcagacactgttgtatcaatttttgcagtagaatatttacacctaacatcatactcaacaccaacactcttgatatatatcatgaattccataggagaatgcgttgcatcatcgttgagtaggtaaactgaacccgtgttagatttaatatccatctctaaaagatatctatactttccatctacttcagtagaaaacactagagattgtctaggtaataagttctcaggaggtatgtcgtctacctttaggcttttataaaatttatattctttagcagattcttcttctaagatctttgattcagtagggctgtccatatatccttcccttaacctgtcagctatctttaaactggttaagttgcctttgaaagactgtcctttgtacaatttgttgaattttgtctctggtatgttttttatggataataatgaattacaaccatttctgcaggcaaataagttttgagcttgattgttgctgaccatacacagatctgaacctaaaacacaattattaagcgatgttgctctagacatcggcacaccagatctgtaaactgtttcagtggttacgtttcctatggagcattcacatgtttcatacccgttatctgtcattccgaacttgtctgttgtcaaagagtctaagttcaagttataatagcacttttccacgcatatattgggttgcttaagtgcaatactggatggtatgtaagaaataaggatcgatgccaaaatcattttagtcacaaataccaagaaattggtgctcagtttagtatttatgataaactgaaattgttggattaaagtcagtttgcgccattcctctttgtctttagtaaaaagatagcattcatcagtgtgatctttagatgctttgtcttgattacaaacacatttttctgtgcaagaatgagttaaaaacgaaaagcatccgcagatcctgcattttaatgggaaatacggccacaaccagttgagtgtccagagaactgggtatgtcaaaataccgatcacatcataccagatgctcaaagcatctttagttttccagatgaaccatgatatggggaatgcaaccatcaaaaacacaaaaatccatttgaagtaagaaaagtttgtatagaagaagatctttttgggttcatctgaatattttgaaacacaattcctcacaggtatgtctactttggcgatcaggctggatttatcgccacaaagtaggaaatggttgccatctagttcttcaggtttgaagtttattgttgtgtcaccagcaatagattttatattaccggatttagagcttttcacattctttatcaaaattcctatgttctcttcagaccttaatttgatttgatagggagacgacatggaaacctggttgattttacagtcaccagacaaccttacagaaagccgggccacagtaggagatttcaagttcacttttgggtcaatgttgatcgggttgttcgatttgtcaacaaagaaaaacttagttcctatttccaacacttttttattctccaactttaggactggaacaactggaaagcttttgaattttaccttcttgaactccttttcatactgacaaatgtcaaatatattggcagagttgctgatgcaggagatgatctcattaccattgtcaatctggtaatgggcattgaagtccctcacacccttaatcatgcaatgccttttctcaaagatgtcacagcttagttcagagacaggtgattgtgttgtgacttcatcatttctaagaatccgggacaatttcttttgtctaggctcaataatttcagttattatgctatcttcttcttcaatgaggtcttctgggtcatccactttgtatctatcttgaatctttctcaactggacactattatccacttgattcaagaggtaaacttcagacacgaaaaaaagcgaaactagacctagacagtagacaagtagatagtatttcttcattcttaagaggtatttcaagagtatttaattgttgcactgattgctct

SEQ ID NO: 341 - DNA, 3057 bp, Groundnut bud necrosis virus
agagcaatcggggcatctaataattctagaaaaacaacgatatactcaagaaatactatttcaggcatgtcaaccgcaaggagtgctgcttctgaattcgtcaaaagctatggcacaagagacaacagagcaatcaatgattgctattctgtcttctctggagaaggtgtcaactttctcaatttgttcatgcataacaatgcaggtattaaatctgcattcagcatcaacgatttgggcaggaatgaggatatcaaaatccatgaagctgaagttattgattcatgccatgattatcattactttgagaagtttgggttagacataatattctgtgagcatgaaatgagcctggttgtggggaaaccaggtgtgaagaatacaggctgcaaattcacaatgcacaaccaaattttcaatcctaattctgatacacttgctttaactcctggaacagtctcagaaaatgagttctatgaaaaaatcaaaataagatcaaatggactacttccctctggatggtatcaagatgaatgctgtaaaaacaacttttacatagctacaaatggagatttgactcttgactacgggttttctgttatgggaaagacaacatcctattggagagaaagtatctctagggagaagattttgtctgttaagcagaagtgtttacctgataacactgtccctaccaacaggctcctatctacatcaactgtaaaaggtattcagctaggatctgaactagccccagacaccacagtgatactatcacttaagcaaaatctgaacgttgacttaaaatctcaataccgcgtttcgtttcatggcatccaagaggaaggtgcttttgcaaggactttctgtgttccttttgaaaacaaatccaggatgatatgcctatacgcaaaaactgttgtggataacagtaatgaaaggactactctgattataaaggtagttacaaaaactattgaatcccatctagtcattcctatcaggaatcacataaattgtgtaaagaaaattggagccaggatagggcttgttgattctattgaaagtgatcctaactataatcagatgattgttaaagagttattgggtgttcatactcaatttgctatcaatttatccttggtcataaagaagccgatcattgtgttcaaaatgtatgatattgagttgaacaacaatcatatagacgtttatggaaggatcctgaattaccagacagatgcagagggaaatgcctatttcctttcaaaaacccttgaagttcttcccaaatcactttccactctgagttacttaggaagcattgcaccaattcaatgggaggaatctttggagcaccagcatttcattgtgaagccagagtaattcaggtttatgtccttgttctacttaagtttattgtgtgcatgttatttaataagcaactaataagtgtttgcttgtttaaagtatataagtattttaagtattacagtataatgttatcaaatataagtttatataaataaaataagctaatactaataagtgtaagtttaataatcgaatataaattaaataaataaaaacccataaaaatcaaaaaacggaaaaccaaaaagacctcgaaagaggcaatcttggcttaactgctttaattaaactcatttatcaaaagttttttacacggaattcatgtttcatggaatttgagatctttcgagtattttaatctcatttatcaacttacatgatttaatcaacatgaggaactatactgaatttggatcccttgagtcctgtaaattaatccgagctagataatcaattccagaaataaagcaaatctatgttcaagaccggccaatcggttgcctccgaagaggtcttttttggttttttgattttttgatttttttgggttttttgttatttatttattttacttattaattattatttggtttatttattatcttactcttatatttattttaaacacaaacacaataacacaataagtaaagtaacatttaaatttaatacacaatgtaaacacataaagaacttataaacacacaaaagagcttatattacttaacaaccacacataaacttagatacatattaacatgcataaacaccttatatgaaacaatttacaattccagcgaaggaccagcctttgaactcttcttcttagaatgttcaccataatcatccattgagagactggcactgaaagctttgtccatgtatttgacttgttcatcatatttcttgagtgagatagagctggctgttccagggttgctctcactcaatagctttacagctgatttaaacatttcctctagttcatttttgaattcaatctgtgaagcagaaagtactttggctactttgcaaacctgttcataagtagaaaagttcttaattcctaatttctctttcttcacattttgataataagccagagggaatataattggtgccagacctgtcatgctagacaagagaggtagaggacctccaatgcagagcatcatccttaaagcacatgtatcgaaagatgcagggacatttaatccataagctgccactaatggtaattccattattttattgtacatctcctgcttagcagcatcattcttgctcttctcaaccatactagccattttggtcctgatgaaagcttctgtccttttgaaggtccagtcatctggccctacatcagtatttgtagcaacaatagttttaccacaaaaaacatacttaccacttttacaagcagcaaagatctgcttcctgcacttcaaaatattcaaacagtttgtaaaagttatttcaagatttttgttggtgtcatagaaagctttaaagctaaatccgggagtggaatcttctgtttcaatttcaacatctgcagagccaccagccaaaagttctttgattttcttctcggtgagttgcttgacgttagacatggtgtttactctggaaacgtctagtatattgactttgaatgaattttattagcgcctcgattgctct

SEQ ID NO: 342 - DNA, 3057 bp, Groundnut bud necrosis virus; identical to SEQ ID NO: 341

SEQ ID NO: 343 - DNA, 3057 bp, Groundnut bud necrosis virus
agagcaatcggggcatctaataattctagaaaaacaacgatatactcaagaaatactatttcaggcatgtcgaccgcaaggagtgctgcttctgaattcgtcaaaagctatggcacaagtgacaacagagcaatcaatgattgctattctgtcttctctggagaaggtatcaactttctcaatttgttcatgcataacaatgcaggtattaaatctgcattcagcatcaacgatttgggcaggaatgaggatatcaaaatccatgaagctgaagttattgattcatgccatgattatcattactttgagaagtttggattagacataatattctgtgagcatgaaatgagcctggttgtgaggaaaccaggtgtgaagaatacaggctgcaaattcacaatgcacaaccaaattttcaatcctaattctgatacacttgctttaactcctggaacagtctcagaaaatgagttctatgaaaaaagcaaaataagatcaaatggactacttccctccggatggtatcaagatgaatgctgtaaaaacaacttttacatagctacaaatggagatttgactctcgactatgggttttctgttatgggaaagacaacatcctactggagagaaagtatctctagggagaagattttgtctgttaagcaaaagtgtttacctgatagtactgtccctaccaacaggctcctatctacatcaactgtaaaaggtattcagctaggatccgaactagccccagacaccacagtgatactatcacttaagcaaaatctgaacgttgacttaaaatctcaataccgcgtttcgtttcatggcatccaagaggagggtgcttttgcaaggactttctgtgttccttttgaaaacaaatccaggatgatatgtctatacgcaaaaactgttgtggataacagtaatgaaaggactactctgattataaaggtagttacaaaaactattgaatctcatctagtcattcctatcaggaatcacataaattgtgtaaagaaaattggagccaggatagggcttgttgattctgttgaaagtgatcctaactataatcagatgattgttaaagagttgttgggtgtttatactcaatttgctatcaatttatctttggtcataaagaagccgatcattgtgttcaaaatgtatgacattgaattgaacaacaatcatatagacgtttatggcaggatcctgaattaccagacagatgcagaaggaaatgcctatttcctttcaaaaacccttgaagttcttcctaaatcactttccactctgagttacttaggaagcattgcaccaattcagtgggaggaatctttggagtaccagcatttcattgtgaagccagagtaattcaggtttatgtccttgttctacttaaggttattgtgcgcatgttatctaataagcagctaataagtgtttgcttgtctaaagtatataagtattttaagtattacagtataatgttatcaaatataagtttatataaataaaataatctaatactaataagtgtaagtttaataatcaaatataaattaaataaataaaaacccataaaaatcaaaaaatgaaaaaccaaaaagacctcgaaagaggcaatcttggcttaactgctttaattaaatgtatttatcaaaagctttttaacttggaattcatgtttcatggaatttaagatctttcgagtattttaatctcatttatcaacttatatgatttaatcaacatgaggaactatactgaatttagatcccttaagtactgcgagttaatccgaactagataatcagttccggaaataaagcaaatttatgttcaagaccggccaataggttgcctccgaagaggtcttttttgattttttgattttttgatttttttgggtttttgttatttatttattttacttattaattattatttggtttatttattatcttactcttatatttattttaaacacaaacacaataacacaacaagtaaagtaacatttaaatttaatacataatataaacacacagagaacttataaacacacaaaagagcttatattacttaacaaccacacataaacttaggtacatattaacatgcataaacaccttatatgaaacaatttacaattccagcgaaggaccagcctttgaactctttttcttagaatgttcaccataatcatccattgagagactggcactgaaagctttgtccatatatttgacttgttcatcatatttcttgagtgagatagagctggctgttccagggttgctctcactcaatagctttacagctgatttaaacattacctctagttcatttttaaattcaatctgtgaagcagaaagtactttggctactttgcaaacctgttcataagtagaaaagttcttaattcctaatttctctttcttcacattttgataataagccagagggaatataattggtgccagacctgtcatgctagacaagagaggcagaggacctccaatgcagagcatcatccttaaagcacatgtatcaaaagatgcagggacatttaatccataagctgctactaatggtaattccattattttattgtacatctcctgcttagcagcatcattcttgctcttttcaaccatactagccattttagtcctgatgaaagcttctgtccttttgaaggtccagtcatctggccctacgtcagtatttgtagcaacaatagttttaccacaaaaaacatacttaccactcttgcaagcagcaaagatctgcttcctgcacttcagaatattcaaacaatttgtgaaagttatttcaagagttttgttagcgtcataaaaagctttaaagctaaatccgggagtggaatcttctgtttcaatttcaacatctgcagagccaccagccaaaagttctttgatttttttctcggtgagttgcttgacgttagacatggtgtttactctggaaacgtctagtatattgactttgaatgaattttattagcgcctcgattgctct

SEQ ID NO: 344 - DNA, 8912 bp, Capsicum chlorosis virus
agagcaatcgagcaacaaattaaagtattctaaactcagtttcaatattaataagaaatactatttctgacactaatgtctggtttagaacttgcaactagactgcatcctattatgatgcaatctgtttttaaaccttttccaagaattatacaattggcagctttgcgctcttttcttgttttagaatctgtactaaatattctattatcggttattatactattgcccataaattatttacattttattcttgacctagagaagtagagtctgatcctaaaaacttattgaaaacctcatgcagttctaatcttttatttcgctttttaggtttcaggttagatatttctaagtcaattttgcttacagcattgaatatcatgctgctaatttcttcgttggttatatttgaatacaaacatttttcagtaagaaattctacatcagcaactatgtaattccttatcttctttaatatcttatattttccagaatcatatacctctagcagagctttttttattaaagcctctgctttaaatggttcttgtacagtgtaattcggagttgccagagatataaagttttccaaactgtcagatacacctaacaagattatctcttttttatcattaagaaaatgcctttgtataaatccacttattcggcatgtcatcacggcatcttgaacacttagtaatctattttctcttactggcttcattgcaaagtggcttctcaataatttcattatatcatgctcttctcctttgatgcacaacattaagaacttcattaattctcctaatagcaatgtattggcaggaatgagataggagctttttttctttgtcagtctcatctgtctcgcgatttgatcataagtggaagaatcatcgatgatctccactgggttcagttctaaattcatttcagctagttttaggttttgaccggtcacactgaatccatggttttctaaaaccattttgactctgtctgaaatttttatgtcttgcaaagagattgtcttgtactcataaaacttgttcatcacctcattatttaatttcatttcataatcaaaatgaacagtgtcagatttagtctttttaaacccgggaatatatgttttgttttttatattcttaaaagcaatcaaatttagcacagaattactagtgtggcaggcttcacatgcctttataagtttaagaatttcaaataaatcaaatccttgtgatgtcatcacttcacttgctgaaagagaatggaaatcagatccattcgccttgtatgttttaattcctttagaatcattgatcattgcaaattttagcatgatacaaacatctttgaatgttgataagctatttgtccactgtgttaacttttctacagcactatttattctatcagttgctctgtacttactttccacgatctgatctaacagatctttgtggaaatcaacagttgtttgaaactcaacttgtgtaagataatcttcaaactcctctgaagttgtacatgtttctaaaccttctatggctaatttgtggatttgatcgacagaatctttaatataatctattgtttccccatcatcaattcccaagattgattgctctattagattttccatctcgttaccatactctagacttttctttaaattagctagtatagtgtctattaagctgtcactttctatcgatttgtacaattcagtgtaacattcccccgtttcagctgttcttaatttgtattttgattgattgctcatcatgttccacgcaaaatctgaagatggtatgtactttatgctgcctttaaattttatcctctctaaagttataggttttgttgtatcattaatcaatatcaacaatgttttgttcgagctctcatggatgcagaactgattgggcattaaatcagacctcatgttgaggaaagttctaattgcactctgcttatctatcagcaacttctgcaacaacttgtatgctgatttaacatgaacttcccagatctttccatcatcttctctttggtattcataaggcgaatgtaaatgaattgaaacatcttgatttgtcatagctaactgtccatagttatactgagtctttattcctattttgtaagtatgtcccgaaacataatatcctctgacatcttgctcatctgtctttatataatggacttcactctgccttatttggtcaataacaaatttgaattctttctcatttatgtacccaaaattatataaccatgccgcatgtttgctcatagcaatcatttgtggtctgaatgataaggttacgtgggttgatgtttttatattatttatagccctcttaacttcagaaatctctgatttcatcttcttcattaaatctaccccattaaagttcaatctacacaatatttgcctaatagattctatggtcatgtctgggaatagactttgtaatctatcagaaacataagcacaacaatcaatcagcttttctaaattcatgtctctctgtagcgatatgataagtcttgagcttctatcgataacgaaattcaagttagtgtaaaaatttatattagttaatctactatatatagtgctccagatagccaatgtattggtgatgaatgttttgcctagattgtattttgagtaaaaagggaaattctttctagaaaaacaggtgttaatagaaagaagtttgttctgagactgaatcatatagttgatgctcaaaacatatcttttcagcacatcagcacattggaattcttctgtcttgtattgcttaccaccgttttgaatacattccttgacatcatcaaatgttttcctatttccaaaaatgtcatgcagtatagagatagatgtttctgtcaaagggagcttttttaaacctagatcaatcaggtaatccataccataaacagctgacatcacgatcaatcctggtgagccttcaattacactaggaactttttctgttataaaccacctgaagttgtagttggcttttggaattgaagcattagcaacagtgttttccattaaggaaataaccatctcaaagttcatatccctgaccatgagctctgaaattgtatttataatcttaaagtcattgcctgatgagttcattatctctttcatcttcaaagacatgttatctttgtatgaaaccatttctttggagttaggatcaagaaatgttttagctttagatcttaatattctgtccagagccagtttttctgttgattgattcgacatctgattccttttacttacactgctatatgtgtaaatgtttgttaaaatgtagtccttatcattcataggagcaattaaaaaagattcaggatgggaagacatatgtctgcttaattcttctaactggatctgggacaagaattttgattcattaatttctccaagatctctttcatctagattattaggtttcaatgcatttagtatgtcagtgtttttcttcaaattgggaaataatttgcagaaatctacaaagctagagttttttaacaaagaactctcactaacaaaactaggcaactttataatctgcgttatcatggattgaaatttcattcccacacttaaactatcacaatcttctgacattaaacttgttttgaacaaatttaccatgcatatcattttcttatctgcaatagttgttcttttggaaatcaatcttttgaataattcatttattctcaaatctatatagcccagagagttaacattcttcttgagactactgaaatcttttatattgaagaagtctaatattatcttgtaatatatcaactgatcatttgaagaaggtccaaggatggatagcaactctacaggagcatacatccaaccaccagcacagataggaatttctctctttgccaaagggaaatcaatctctttgacaatagtagttatgtcgttctcctcaccaggtaacattgagtatatgcttaatgactggacctgtattgctgcataagaaaaaggtattaattcgtttggacaaccttttcttaaaagcatggtaatatggatagagagagacattaagtcatcaaaatagctattatgggagctttcagtactgcaattggccaaatgcctgcaatataaaggaatgacagcaccatttattattctttctgatataaattcaacttctgattctgaagcatagctttttttgggattgagcgttatgcaatagctcttgaaatgtgattgtatgcttctgaaaagcaattctgacaaactagaacaattgaagttcaataacaattccttaatgttccctctgaccaccattgatgttgcattgtcatcagaatgaaccatccaccttatggtgaagtcatagtctttcattcttttcatagacttttcatagcccatcatggcacaagagtgatatacagatgataagtaattcaagttcccttgaagccaattcattgacacagggaatgtgtttgtttccaaattgtctgttaagacagataaagcagttccgtatgagccatattctgtttgacctctttttagattgaggaagatgtcggttggaatgcaaactcttttaagcttgacatacatcattatacactcacacatcaggtttatttctccggttgttaagatagggttcattataacagctaatatgtacttgtatgtcaaatctgatgccgaccattttgattgatctgctgataagaatgccattttgcattcaaggtttttttggagtgccgtgttataatttgttatagtatcatatgatagcgatgcaaggtttttaatcttataatctccagatattgatattgcctcagaaggatctgcttgggctacatgtttgtatgtgtgctcaataaaatacagcatcatctttgtcttcatgctcatgagataaatctctctatccatctttgtcctctgcatcttttcaaacactgaaacaaggaaatctgtatttcctgcattggtcctagacttcatcaaaatgaattcaagtagttgtataaatgttactctattacctttcaatcctcgacccagcttttctaaagcttccagatcaatctctgtaatcttgttgaattctttgatcaaatcatatagctcctcactaaccttttttgatttcagaacagtagttgtcttgaagtagccatatcttactttcataaatgtctccactgtcaatggatgactcttgtagtagaatttgtcctgatttgttttcatcaagactttgttgctgcctgacatcatattagagaaaaaatgaatatattttgattcatccaaaccttcaatctccataaaattaatcaaagattctctgtcttcttcaaaacattttaaaacccctttaagtatgtataagtttggtccttttatatcatcaggatgtttcccaaatactgattttagagctgctactatttctgtattctttataatgtcggcttttgagcacttttttgaagatgtcaatgtttttattttgtatggtgctgataagaaatcttctttatcttctatatttgatctgcaggcaccaacattgcttatgttcttcctataatagtcgaacagagtttttatgttgagaacaccatctatagaaaatggacctgaatcattgaacatctctttcttgggcttaatttcttcatctaacttgaaacccatcttttctctaaacttaacttcccattcagcaggtacacttaagagggttgtaaggttatgcacatgggtatggagtgatttaggcatcatatagattgctagataaacattattgtaaagacattctatagtcttcaatgttgatcctgttattgggcagacgatgtctaagtctgatatcccacctgacatgtcattttcttggtctatagtcaaaggttttatgttgttgctcaggttgattccctccattttcagtagaagagtttttatgcctgatacaaaaaagcagtctataacatttgttatgtctggatcaaatttctctgctatatattctttgatatttgaatagtcagaaagtggtaagaaccctgcatatctcatgaaatcaaatattcccattctactgagtttagtgacagtgcctatgaccacagaagaaaacaagattttctgaagatactgaatcttattttcagggcaggtgaaaacatctatagaaggctggttcaaccacttttttatttctgtacttaataatgaatattgtgagaataaaataggaactttgctgggtgctttaaacaagctaagaagcctcacttgatttagtctttgtggtttcattatattgacaaaataattccctgatctaaaagatacaaccaattcttttgtgtagagagaaacaaagtatggttgtatatctttttctactctgtgcagagttatatatgggactcctgacttacctgtgttaataccatctcctttgaatgcgaggcatatcatacttgtgttagcacatgtcaaaatcttgaagtcagttttcttcataaatcgatctgctaccattaaacctttagccagctgcatcatatcttcactataggtatatatagacaactctttagatacctcatggatatttttagcaattgtcatttcagattctattaaattacctttagtgaataatgacgcagggttagagcagtactcatcataaactgagtttattttactctttttatttttcctttcatccataccataaagtacatacatagcttctatcatagactcgcaaaaatacttgacgtcagggttgtcatgtctaataagctttttgttgtgggtaatgcttttcaaactcatttgataaggtatgtcagcttttgatatatcatactccccactaggagtttcaggttcatcattatcctttttagattttgcctcttgaattttgcttttaagctcattttttatgtctattttctttttctttcccatatctatatacatcagactcaggcctttaaagaagtgttttctagcgtcactagaagttaaaggtgataaggtaaattcattgccatttctagtcttcacagaacctatctctctccatgtttgagaggtgtcagttcttttaacttgaatgctaccatctttgacgtccacaacatcttctagagctgcttttgaatgccctgtggtgtcaatgcttagatccattaagcaagttttcactaggttaaaaagggtcatggagaaatgtaaatctactttgctgccaccatacgatttatggtgaatcagcttgggctgttcgatgaacgaagtcctgaaagattgtattatagcattattatagttgagatcattcatttttagttcttctgtcatcggtgaccaacaaatagagaaatttgtttttgtctcttggagatcatttgtaaagcaacctggatactctttctggtactctcctgcatttatgttgaaagccgtttctatgctatctatttctgtttctttagcttttttagataaaacatcagattttattttgttgaaatgactttcataaagttcttcaaatgtatcttcatttttgtctaaatacctttttaactcttcttctgtttcaatggggtcaaccttcatcatttcacagtgtgctttatacccctcaaacctgtcttttaagtgtaaatcactcatagtatctttaaaatatagatagctaccaaataaaaaatggactatcatatctttttttattttctcattcggcatagcatcaattagatcaattatatcttggctagtttgattgttcgttaaatttgttttcctgtactcatatgaccagtggctaaaaaagacttctgatgatctgttcatgtactcgcccacttttgataaaagagagtttttgaatgcttgagtctctgcataaaaccgcctaaagcaatcagttcccaatccaataagctgtcctatagagttaacagatatcaactttgctgcaagagctgcttttcttctatcattgaaagttctgtagggtgaatttctgagttcctgaatcactctactcgtcgtagcagtaattgacatatttccactgggattgagtatgactatggtgacaaatattggatgcctttccaaaaagggctggccatctacagttatgtctttaaatgttttccacacactcgtgtaataattttcagatgttttagtttctgacatagtatccacagagactttccagtcatatatcatcagacatgctctttcacccgatgtttctttgtagattgtatagttatcaggtgtcaagtgttggaagaccaatttttctttcaggtcgtcaatattaggtattttattcataatagaggtagaggtattgcaaaattctatataagacatgagacagtctttcaggaagacatctgatctatgtttaggagcaaaatgcaactttcttccagcaagtacaccgaatagatcatgtctcatcagttcaagttctttatatttatctaagaataaaaagatttctgtttccatttctttttgatcaatagatgaagaactttggtggtatctagacttcatgtcttcaattttatctaaaatataattcattgacattattgaattcaaaccagagtcaatgacacctttaccttcagggtaacttctctccacaatattcgacattgacatgatttcatcttttatcctttgtagatacacagtaatttcccctgatgtatctaggaaactgtttatagtttggatgttcattactgatattttattgttgcacgattgctct

SEQ ID NO: 345 - DNA, 8912 bp, Capsicum chlorosis virus; identical to SEQ ID NO: 344

SEQ ID NO: 346 - DNA, 4823 bp, Capsicum chlorosis virus
agagcaatcggtgcgccaattattagataaaatcattaaaatatcatcaagaaataatgtctcgcatttctaacgtgttggaatctttccgtccttcaaacagctcaaaaaaagagctagtccctgcagtgaaaatggagaacaatagaggtcttctggctaggaatgtttctcagaaagacattgacagtgctttactgaacaaagccaaaacaataaatggtaaacagtatgtttctggaggagactccagtgtgttgggcacatattctaatgaaatggttgtggaggctacttcagatgacattttatcgaggcttgttgttgaacagagcactcatctgagcaactggaagaatgattctcttgtcggtaatgggaatgacaaagtcagcttcactataaatataatgccaacctggaatagtgggcggaggtttatgcatatatcccggcttatagtctgggttgtcccaaccatcccagattctaagaacagtgttaaagccactttaattgatcagaacaagatgaccaaagctgacaaaatagttataagtaggcaagcttctctgaaagaccctatgtgcttcatttttcatttaaattggtcgtttcctaaggagaggaacactcctaagtactgcatgcaactcaatttaacaagtgatgagaaatatgccaagggagttagctttgcatcagtgatgtactcatgggtaaaaaacttttgtgacactcctattgcctctgaaagcaacacatgtgatgttgttccaataaacagagctaaagtgattcaatctgctgctttgattgaagcatgcaaattaatgataccaaaagggactggaggtaaacagatctctaatcaaatcaagagcctgcaaaaagttgcagaaaagctagcattggaagccgaagatgaaggagagagcattgacgtggatatagaaatagataatctccttgagatttcttaataactaccagcaacatgtgtgtttaagtaaattgaatttaagtagtaatattatctatttatattttatataattaaatcacatagaataagtcaatacagttaaagtaaatgtttatttgtataatttatgttcattatgttatgtagatatttatgtgtgtagctttaagctaaaacaaaagagtaaaacagcaaaacaaacaaaaaaagtaaaaataacaaaacaaacaaaaatgaaacaaaacagacactatatttataaataaataaggcttaggccaggtgttggcttttcagcctttttttggatttaaatcattttactattttttattcatttatttacttcatttataactttcttattatatatactaaatacttaatgggacaatctgaagagctaaaatctacttaaatgacttttaaatttctagagaaaagtcataatcttttggaggagattttctcttcctagcctgatcaactgatttataattagttagaagaacacttgattccatggattctatagcatcttctagcttttgtcttcttttatcaacataatatgtctttgataacctgaatatactgttcaagatgtatatgccaatgcatgcagctgctataactaagattatcctaaccaagtcaaagaagttaccgaagaaagaggcaacccaattgaaaggtgctttcacccaatcccaaaaactggatatagaggtgtctgaatgatgtatgttctcatcatgtgcacttttatcatcaaagtgtatgatcgtgtcttgatcaatatggataaattcatcaacaggaatgtctactgtcagctcatcttgatcttcagggattagcttcaaagatttgtctgcaatctcttcggagcaataagcttttatagattttctattgggacctaaaaatgttcccagttggtcagacttaaaagaacaagtatccatcataagccttgatgagaaagttgtatcagaagtataagttatattgcaatcaatccctgcagcacactgagaacacccagagcatatcattttagcctccgagataataggttttgtagggatttttttgaacatttccttaggcatgtctataaccattttaagtttacctaccaggaaatcctttcccatatataatttgttgttgttttcatctatttgagtagcatcttttgatgtagataaactatagatattactatatgtatacaatccacattgtctgatgttaaccttcttttctcctacagcactgcaactccaagtgaagtcttttggtgataaagttgtaggaacagataatggtattccatccgccgtaatttggggatgtccaaatgatgatcctgcaaaatctcctagatcagctatattcccagtaagaattttctgctgcttatctactgcaaacaatttgtctgtgctcatgtaatcgttgtgcaaatcaactgacatgtcaagctggtaataatcagtttgaataggagatctatcagaatgttttttacaagagtatccatctaatgatttaacacatatttctgcagtgacatgactttcaataacctgatatatgttgaccaagcttgatagatcataaatattggtgcaatgcccgcaaattcctccttcatttattgctaaacagccaagctcttcacaaccccaccaagaagtcagtgtaacacaaaaatctaacattcctaccttaggtttttgtttaatgcaatcagtgcaggcacctgtgcatgttaccagataatctgctacagttgtatctacttttgctgtagaatacttgtatcttacatcatactctacacctacactctttacataaaccataaactccatgggagagtgagtagcatcatcattaagcaaatatatagagccagtgtttgacttaatatccatttctataagatatctgtattttccatcaacctctgtagagaatactaaagactgtctaggcatgagattctcaggagggacatcgtccacttttaaactcttataaaatctatattctctagcagattcttcttccaaaattatagattcagtggaactgtccatgtacccttctctcaacctatttgctatctttaaactggttagattacctttgaaagattgtcctctgtacaacttattaaatttaacgtctggtattgtttttatagatgcaagagaattacaaccattcctgcatgcaaacaaattttgagcctggttgctgctagtcatgcacatatctgaaccaatcacacagtcattaagagacgtagccctggacatcgggactccagatctgtatactgtctctgttataacattccctatagaacattgacatgtttcatacccattatctgacattccaaacttatcagttgtcaaagaatctagatttaaattgtagtaacatttttctacacataaattctgttgtttagatgctatacttgatggtatataagagataaggattgatgccaatatcatttttgtcacaaataccagaaaattggtgctcagctttgtatttattataaattgaaattgttggattaaagttaatttatgccattcaactttgtcttttatattaagatagcactcttcagcatggtctttagatgcctcattttggttgcaaacacacttgtctgtacaagagtgggtcaaaaacgagaaacaaccacaaattctacacttcaaggggaaatatggccacaaccagttaataatccataaaatagggtatgttaaaatgccaaggatatcataccagagacttaatgcatttttagtcttccagatgagccatgatataggaaatgcgatcatgagaaacacaaaaacccatttgaaataagaaaaatttgtgcagaaaaagattttcttaggctcgtttgagtactttgaaacgcaattacgtaccggtatgtctactttagcaatcaagctggatttgtcaccacaaagcaaaaaatggttaccatctaattcttcaggcttaaaatttattgtggaatcgccaatgatagattttatgttttcgagcttcgagctttttatattttttattaaaatcccaatgttttcctcagatctcagtttaatctggtaaggagatgccatcgatacttgactaattttacagtcacctgataacctaacagaaagtcttgcaacagttggggattttaaatttacttttggatcaatattgatcgggttatttgatttgtcaacaaaaaagaattttgtgccaatttcaaggacctttttattctccaatttcagtacagggaccactgggaaatttttgaacttgatctttttgaactctttatcatattgacagatctcaaatatgttcgaagagctgcttatgcacgaaattatttctttaccactatcaatctggtaatgagcattgaaatcactcacacctttaatgatacaatattttttctcaaagctatcacaatttaaactcaatgatggttgatctgttgcactttcatcgttccgtaaaattctggacagtttcttacctttggtttcaggtgcctcagttatcacaggctcttctttatcaataaggtcttcaggatcatctactttgtatctgtcttgcatttttttcaattggatgctagtatccacttgattcaagaggtagacttcagacacgaggaagagcgaaagtaagcctaggcagtagacaagtagatagtatttcttcatctttatgaggtaattcaagagtatttaattgttgcactgattgctct

SEQ ID NO: 347 - DNA, 3399 bp, Capsicum chlorosis virus
agagcaatcgaggcttctaataattcaagataaacagcaataagatcaagaaatactaattcaggcatgtctactgcaaagagtgctgcttcagaattcgtgaagagctatggaacaagagacaatagagctatcaatgactgctattctgttttctctggagaaggtgtcaactttctcagtttgtttatgcataacaatgcaggtattaaatctgcattcagcatcaacgatttgggaaggaatgaggatgtcaaaatccatgaagctgaggttattgatacatgccatgattataattactttgagaagtttggcctagatataacattttgcgagcacgagatgagactagttgtgaagaaacctggtataaagaacacaggctgcaagttctcaatgcataatcagatcttcaacccaaacaatgataccttatccattgtcccaacgacaattcaagaggaagtctttcatgagaagagtaagataagatctaatgaccttctcccctccgattggtgcttagatgagttctggaagaacaatttctacatagccacaaacggagaattttccctagactatggattctctgtgatgggtaaaacaacctcctattggagagagaacatctcaagagagaagatcctatctttcaaacacaaaagccttcctgacaacactgttccaaccaataggttgttgtctacatcaattgttaaaggtattcagctaggctctgagttagcacctgaaactacagtaatactgtcatgcaaacagaatcttgatattgatctgaaatctcagtatcgcatttcatttcatggtattcaagaagaaggtgccttcacaagaactttctgcattccatttgagaataagtctagaattatttgtttctatgctaaaactgttgctgacaatagcaatgaaaggacgactttaatcataaaggtggttacaaaaaccattgattctcacttgatgatacccatcagaaaccatatcaattgcagcaggttggttggagctagaataggtttagttgatttctgtgatgctgatccaaattacaatcagatgattgtgaaagaattacttggtgtccacactcagtttgcaatgaatctatctggtgccctgaagaaacctatcattgtgttcaaaatgtatgataaagaattgataaatggacatgtggaagtttcaggaagagtcttgaactaccaagtagatgcagacgggaacatttacttcctttcaaagactcttgaagttctacctagatctctttcaacattgagttatttgaatagtgtagcaccaacactatggaaggaatctttggagcaccaacactttattgtggagcttaaataacttttgagtgaacaactctgtccattgctttaatataatcatttagataaataattttccaatataaactttataagttaagataaccataaatccataaatataaccaaataaatatagccatagtcaagtaaaggtaactatagctaaataggaatataaataagtaatttaaattccaaatttaatccaggtaaaatttaatcaagtatacggtcataaacttagttattcattagtaaataaagacctcgaaagagctaatgaaccaaggggtcaattctcccttcttcccagatctcataacactgaacgttctcctcaccatataaaacatatctcgaaccttcctgttagcataactcttttgtcttgactgcgccgtatgaagccgctcctgaatcactttcaccttgtccaaagcatcctgtaccaagtgtgtacccaaaagcttagcctcgcccgcctcaaaccaacttggtccatctgaatactcaattgataactgttgttttaagcaaactccgtgaacgttataaactggtcccatgaacccccaaaatcaatgacacaagcgcacaacctgtccttcaatatatgaatagtgcgctcggattgccgtccatctgagggtgaaaagttatgattaactcaacctgagtacctaacactcgttatacaactcccaaaaactacgatgtgaactgagtacctctatctgaaatgatgaaaactgggacaccatgcaggcgagcaatctctcggatataaattttggtaaccactttaaaaaataggtagtacacactggaatgaagtgcgcggacttggtcagtcggtccacaatatttatagatatgtatatttatatatttatatatttatatcttgatggaagatagatatatatactttagacaaacttttatctatttgagaactttctatatctatatttacgcatattgaacaaacaagcacgaagtataagcagatgactgtagtatataaattataatctaaataaactaacataaatcgatttatatataaacatgaatataaatttatatgaatatagttatatattctacatataaatgactatatctacttaaatcacacttctatagatgagctaggtttggagctcttctttgaatgttcaccgtaatcatccacagacaaattagcactgaaagccttatccatgtatttaacttgttcatcatacttcttaagtgaaatagagctagcagtaccagggttactttcgcttaacaacttgacagcttgtttgaacaacctgtctagatcttccttaaattctacttgagaagcagaaagaactttagccactttgcaaacctgctcataagtagagaaattcttaatgcctagcttctcttttttgacattttgataataagccaacgggaagatgactggtgcaaggcctctaatgctggacaaaagaggtaggggtcccccaatgcatagcatcatcctaagagcacaagagtcatatgaagtaggcacattcaacccataagcagctactaatggcaattccatcacctttgcatacatttcctgcctggcagcttcatttttgcttttctctaccatgttgaccatctttactcttatcagagcctctgttctcttaaaagtccaatcttctggaccaacctcagcagctgtagaaacaatagttttatcacaaaatttatacttaccacttttgcaagcagcaaaaatctgttttctgcattttaagatattcaagcaatttgtgaaagtcatttcaacacccttgttattatcataaaatgtcttgaagttgaatcctggagttgaatcatcagtttctatttcaacatctgcagtaccaccagccaagagttccctaattttcttttcggtaagttgcctgacgttagacatggtgtttactctggaaacgtctaatatgatgactttgaatggatttattagcgcctcgattgctct

SEQ ID NO: 348 - DNA, 3477 bp, Capsicum chlorosis virus
agagcaatcggggcttctaataattcaagaaaaacaacgataagatcaagaaatactaattcaggcatgtctacttcaaagggtgctgcttcagaattcgtgaaaagctatggaacgagagacaacagagccgtcaatgattgttattctgtcttctctggagaaggtgtcaactttctcaatttgttcatgcacaataatgcaggtattaaatctgcattcagcatcaatgagctggggaggaatgaagatatcaaaatccatgaagctgaggttattgatacatgccatgattatagttactttgaggagtttggcctagatataacattctgtgaacatgagatgaacctggtcgtgaaaaagcctggtgtgaagaacacaggctgcaaattctccatgcataatcagatcttcaatccaaacactgataccctatctattactccagggacaatttcagaggaaactttttatgagaagagtaagataaaacttgatggactccttccttcagattggtgtttggatgagtgctgtgagagcaacttctacatagccaccaatggtgatttctccctggattacgggttttctgtgatgggcaagacgacttcttattggagagagaacatatcgagggaaaagattttatcttttaaacacagaagtcttcctgacaacactgttccaactaacaggttattgtcaacatctattgtcaaaggcattcagctaggttctgagctagcttctgacactacagtgatactatcatgcaaacaaaatctcgatgttgatctcaaatctcagtatcgtatttcatttcatggcattcaagatgaaggtgcttttgccaggactttctgcattccatttgaaaacaagtctaggatgatttgcttttatgcaaaaactgttgctgacaatagcaacgaaaggacaactctaatcattaagatggtcacaaaaactgttgattctcatctgatgatacctgccaagaaccacattaactgcaacagattaatgggagcaagaatagggctagttgatttttgtaatgttgatccaaactacaatcaactgattgtaaaggaactattgggtgtccacactcaatttgcaatgaatttgtccggtactctaaagaagccgatcattgtattcaaaatgtatgataaagaactaataaataaacatgttgaagcttcaggaaggattctgaactaccaagtagatgcagaaggaaatatctactttctttcaaagactcttgaaatcctacctaaatctctttcaactttgagttacttaaatagtgttacaccaacatcatggaaagaatctttggaacatcagcacttcactgtagagctcaaatgaccttaaggagcacgatacgatataattattctattttaattatctaaataaatagctatagattgtaaactttacaaatagatataattatatgtatatatatctatatatgcatatatatatatatatgcatatacatacatatatatgtatacttatatacatatatacagatatgcatataaacataaaatataaatacatataaatatattaataagtaaatatagtaaataatttaaatgcaagtttaagtcatgcttaatttaattaaacacattgctacaaatctaattattgtaaactttattggaaataagtgaatctcaattacataatcaaataagttgaaaatccataaaaatcaaaaacaaaaaaccaaaaaagacctcgaaagaggcaaacttggcttaattatttcaaaattaaaactatagttgctatttagtccattttttggacacttatttttacattaacacttcaagtgaatttgtctatcattgaccattatttaaactctattaaataacatgttatatctaaagagcaaaattagggctaagaatttaactatctgatctaatttagtaaagtcatctacttatttagcataacttatttaaagccttcctctaaatacttacttaagtaaattaaattatttatttaataacccactgattcatttgatcaagaaatttgatttgagcaaacaatttaagatactgaactcatcttgatggatcattgtaatacatccagtctaactatttataagagagcacaccagtctgctgaggtaattaaataatttagattcatgattataataggccaacagtttgcctccgaagaggtctttttggatttttttgtttattgattttttggattttttgtttttgattttttgggtttttgaatattttcaattctacttatctgtatttatgaacatacatatacatatatatatatacctatatgtatatatatatatatttatgtatatcttggttacacacagatatataagtttatgaacatactttaaactacttaaatacttgtttacctatactaatacaaattaagcaaataaacatgatttagcttgtaaacaaacatgtagtgaatatatgtatataaacaaatatatatatttttatatataagtaattattttgcttaaatcacacttcaatagatgtactaggctttgagctcttcttcgagtgctcaccataatcatccacagacaaattagcactgaaaactttgtccatgtatttaacttgctcatcgtatttcttaagtgagatagagctggcagttccagggttgctctcactgagcagcttgacagcttgcttaaacaacttatctaaatcttctttaaactcaacttgagaagcagaaagaaccttagctaccttgcaaacctgttcataagtagagaaattcttaattcccaatttctcctttttaacattctgataataagctaatgggaaaatgattggtgcaaggcctttaatgctagacaaaaggggtaaaggccctccaatgcatagcatcattcttaaagcgcaagagtcaaatgaagcaggaatattcaacccataagctgccactaatggcaactccatcacctttgaatacatctcctgcttagcagcttcattcttgttcttctctatcatattgatcatcttaactcttatcaaggcttctgttctcttaaaagtccagtcatctggaccaacatcagcagccgtggaaacaattgttttgtcacagaatttgtactttccacttttgcaagcagcaaagatctgcttcctgcactttaggatattcaagcagtttgtgaaggtcatttcaacacttttgttactatcataaaacgctttaaagctaaatccaggagttgaatcatcagtttctatttccacatctgcagttcctccagccaagagttccctaatcttcttctctgtaagttgcctgacggtagacatggtgtttactctggaaacgtctaatgtgatgactttgtttggattttattagtgcctcgattgctct

SEQ ID NO: 349 - DNA, 6245 bp, Pepino mosaic virus
gtacaatctagcatttgtgaagccgcttaccaacatgttagacctgtgctcaaggaatccctaatcaactgtccttatgcgcttaatgactatgaagcagacacccttgagaatttaggtgtcacaataaacccccatgcaatccaaacacatactcatgcggcagctaaagttgtggaaaatagaatgctcgaaattgttggacaccacttgcccaaggacgagaaagtcaccttcattttcctcaaaagaagcaaactgagatacatgcgaagagctgctgtacataaagatgtttttgttaatcacaatatagaacccaaggatttcttcaggtatgatgaggaatctacatctactagcttctccgtgaacaccaggatcgcttacatctccgattctctacatttcatggaaccagctgatgtgacccacctctttgaccgttgccacaatcttaaaacactgatggcaactgttgttttacctgttgaagccatccacaaacaaacatctttatttccagcgatatactccattaattacaatgaagaaggttttgagtatatccctggttctcatggtggaggggcatactttcataagtatgaaacattagactggctcaaatactctagattcgttggccaggaccccttaactggactccgatacaccataaccattcaaatggtggagagtttaggagccaaccatcttttcctcttccaaagaggaaatttcgaaacacctttatacaggacgtttcaaaaaaatagctttgtgacctttcctaacatcttccatccccaacatgttaatgccacaaagcccatgccaagatccagggcaattcagctgtatttatatgtcaaatctgtcaataaggtgacacaaagagatatctttgcgaaagtaaggcaacttatatccacagctgaacttgaattgtatgaccctgacgaacttacacatattgtcaattatttcgcatatgtctcagaactaagctcaatcaacgactatgacaatatgctcaaatcaagttttttcaaaaaacttgttgcacccatgcaacatgactggaggtgcatgattgaattctttcggggaaaaagtgatttcaatcaacttttaactgctcttcaatggaaagacttctcttacaccattaaaacggaagagttagttattgctacacacactgaaattggccaggcaatctgtaaagctgcgaccacatacaaagaaagaagacaattgaccaatttagtcaaacaaggcgcagtaacattagctgatttcaaagaagcggaccagcatgtggagtacactcactttgatcctgagtttaaatccactgttgacccccaccggagctatgaaaatgccatcaacaatcttggcattgagattaatgaggacgtacctgaaagttccggcactaatgaaacattgcttaacaatgaaatatctttagcaatgtcatctactgaacatgtgcaagctgttcaagaaattgagtctttactctctaaccccgaagcggcaccaatattgccccctgcacatgttaaaacatgggctagccttgcatctgacacttcaagcactaaaaaccgtgaaatcgaagatatagtggctaagctggaaatacaaagaaataaagctagttgcagctaccttcaaccaaataaggaattgtcaaaacccaaggctgctgataacaatctcccctggaattcttggatcccattgcttaatgcacacggcttcaaaggagatcaattacaatacggcccagatggtaacttgatacagcccatccaagacattaacaattcacagcctagatctgactatccgtcttctctgccatgtgaacttgtggaaactttgaggaaaatcaagcgtgctgtctatgccatcccaataagccacaggagggctagtgcttacagttctgacatcaaaaataacagaactggcaaacttctctgcaaccaaagcaaagaatggaaagaaagctttgctttcaaaatgcaacatgaagacatcgtcaaatcaggtgttgtcatacatggttgcggaggctctggcaaatcccaggcattacaaaacttcttgagaacattgggtgattcaaatgattgctgtactgttgtagtacccactgttgaacttagaaatgactgggtaaacaaactccataaattgcccatggagcatatcaaaacatttgagaaagcaatgattcaacctggctttccaattgttatatttgatgattacaccaagttgccacctggctacattgaagcatacctatttcaccatgccaacactgagcttttcatacttactggtgattctaggcaaagcgtgtaccatgaatctaacaatgaagcgtacattgcctcattagatgaagctgttgcatactacgctaattactgcgggttttatttaaatgctactcatagaaatgtccgtagtttagccaacaaacttggtgtttacagtgagaaagaaggacacttgaaaatcacttttgcttcacatgccttacaaaagtgcaaagtgccaattttagttccatctcaaatgaaaaagagtgctatgttagacattggacataaatccatgacctatgctggttgccaaggtttaacagcacccaaggtacaaattctccttgataaccacacgcaacattgctctgacagagttctgtacacctgtctgtctcgtgcagttgattccatccacttcatcaatactggtcccaacaattcagaattttgggataagcttgaagcaacaccatatctcaaagccttcattgatgtctatagagatgaaaaaactgaaatgctcaattctaagcctgctgatgacagtccaactgagcctgaagcacctgttacacatttcccaatagcaaatggaaataacttagagaaattagcttctgctttgcctgaaaaatttgctagggagatttatgacaagcatcatggccactccaacacaatccaaactgagaaccctgtggtccaacttttccaacatcaacaagcgaaagacgagacactcttttgggctacaattgaagctagattgtccataacaactcctgaagcaaacctcagagaatttttgcttaagaaagatgttggagacattctcttcttcaattaccataatgcgatgtgcttgcctgccgatcctgttgactttgaagaaaagacctgggagatctgtgctgctgaagtgaaaaacacttatcttgccaagcccatggccaatcttatcaatgcggcaagtagacaatcacccgactttgactctaataagatctcattattcctaaagtctcaatgggtgaaaaaagtggaaaaacttggagctatcaaatcaaaacctggtcagaccatagctgcttttatgcaacaaacagtcatgttgtatggtactatggccaggtacttaaggaaaatgcggcaaagattccagccaaaacacatattcatcaattgtgaaaccacaactgatgatctcaataaatttgtcaaagatggctggaactttaacagaaccgcccaaacaaatgacttcactgcttttgatcagtcacaagatggagcaatgctgcaatttgaagtcatgaaagcaaaattttttaacattccagctgatgtcattgaaggctacatcaacatcaagctgaatgctaaaattttccttggaacactctcaataatgagactttctggtgaaggtcccacatttgacgctaacactgagtgttcgattgcatacactgccacaagattccatattgacaatactgttaagcaagtgtatgccggtgacgacatggcattagatggagttgtgagtgaaaagaaatcattcaggaagttacaaaatctactaaaactcacttcaaaaacgctgtacccaaaacaggttaaaggggattacgctgaattttgtggttggactttcacaccagggggtataattaaaaatccacttaaaatgcatgcctcaattatgctgcaagaagccattggcaatctgcacacagcagccagatcttatgcaattgacatgaagcattcataccaaatgggtgaccaactgcatgactacctaacccccgatgaagctgaacaacatttcctagctgtgagaaagcttcacaaactccatcaaggcgaggccatgcgtcttggggagaaaagtccaccaagatcaacccattaaggggttaagttttccccagtttgaaatggaaagatcaactttgatcaatttacttctgttacacaaatttgaacacaagattaacactgaaggaatcattgttgtgcacggaattgctggaactgggaaaaccacattgcttaggactttattttctgcataccctagcttagttataggttcacctaggccttgttacttagataaagctaataaaatttcacaagtttgcctttcttgttttccaaataccttgtgtgacattgttgacgagtaccatctcttagaaagttttcctgaaccaaaactagccatttttggtgacccctgtcagtgcacttacattgaaaggttgagaacacccaactacacatccttcagaacacaccgatttggcaaatccactgctgctctactaaacaagttatttgatcttaacattgagtcagtcaaagcacaaaacgacacagtagaatactttgatccttttgcagtggacccctctgaacacatttctgcttcagaaaaagaagttttggaatttgtaggtgatcaagttgagactacaagccctgaagaactagctggtctcgagtttagtgaagttactttctactgtaccacactcgctggtgctgttcaagaaaatcctgctaaaaccttcatttcactcactagacacacttcaaagctcacaattggtgaactaaatgccaggtctgactcctagagctgatcttactgacacgtataaaatcattgctatagcctttctactgtcagcttgcatttacttccaaaacagtcattatcaaccagttgcaggtgataatttgcacagactaccctttggtggtcagtatcaagacggaactaagaagatttcttactttccgcagcaacaatcctactttcactcaggaaacaagcttaatgtcctcatacttatcttcattcttacactgggtattgtcctcaccaataaatttagttttagcattagccgtaatactcaccagcatcattgctacaacacacattctgcaacccaaacaggtcaatcagtgccaggtcatcattgacggtgcagccatagttataacaaattgtccaaacacacccgaagttcttaaagcaatcaacttctccccttggaacgggttaagttttcctcaattgtgaaatcatatttgttatctagttaaattcaaacaatttaactcaactatggaaaaccaacctacagcttctaacccatcagatgtaccaccaactgctgctcaagctggtgcccagagcccagccgacttctcaaatcctaatacagctccttccctaagtgatttgaagaagatcaaatacgtgtcaactgtcacttcagttgccacgcctgctgaaattgaggcccttggcaagatctttactgccatgggtttagcagccaatgagaccggacctgccatgtgggacctcgctcgtgcttatgctgatgtgcaaagttcaaaatctgcacaacttataggtgccacaccatccaaccctgctttgtctagacgtgcacttgctgcacagtttgatcgtatcaatatcacacccagacaattctgcatgtattttgcaaaaattgtttggaacatactgttagacagcaatgtgccacctgccaactgggcaaaattgggctatcaggaagataccaagtttgctgcttttgacttctttgatggagtcacaaatccagctagtctacagcctgctgatggcctaatcaggcagcccaatgaaaaagagcttgctgctcactcggttgctaaatatggtgcccttgcccgccagaaaatatccactggtaattacatcaccacccttggtgaagttacacgtggtcacatgggcggcgccaacactatgtacgcaattgatgcacctcctgaactttaaacactcgaaacttaatcagagtggggttttct

SEQ ID NO: 350 - DNA, 6411 bp, Pepino mosaic virus
gaaaacaaaacataacacataatatcaaaagtgaccaaacacaacataaccacgtggaaaaacagcgaaagcactttaccacattatgtctcgtgttagaaacactttagaaaagatcagggacccacaagtacagtcaagcatatgcgaagcagcataccaacatgttcgaccagttttgaaggaatctctaatcaattgtccctatgcgctcaatgattatgaagccgacacccttgagaatttaggtgtcacaattaaccctcatgcaattcaaacccatacacacgcagcagctaaagtggttgaaaaccgaatgctagagattgttggtcaccatctaccaaaagatgagaaggttaccttcattttcctaaaacgtagtaaattgcgttacatgagaagagctgctgttcataaagatgtttttgtcaaccataacgtagagcccaaagatttttttaggtatgacgaggagtccacatcaacaagcttctccgtgaatactagaatcgcatacatttcagactccttacatttcatggagccagctgatgttacacaccttttcgaccgttgccaaaatcttaaaacattaatggcaaccgttgtcctacctgttgaagcaattcatagacaaacatctttatttcctgcgatatactccattaactacaatgaagaaggctttgagtatatccctggttcccatggtggtggggcatactttcacaagtatgagaccttagactggcttaaatattccagattcataggacatgatccattgactggcctcaaatataccattacaattcaaatggttgaaagtctaggcgccaaccaccttttccttttccaaagaggaaattttgaaacgcccttatataggacctttcaaaaaaatagttttgtgacattccctaatatatttcatccccgacatgtcaatgccacaaaacctatgccacgctccagggcaattcaattgtacttatatgttaagtctgtcaacaaagtcacacaaagagacatctttgcaaaagttagacagcttatatccacagctgagctggaactgtatgaccctgatgagcttactcatgttgtcaattacttttcatatgtttcacaattgtcatctataaatgattatgacaacatgctaaaatccagtttcttcaagaaattggttgcacccatgcaacaagactggaggtgcatgattgatcttccggggaaagagtgatttcaatcaacttctcaccgctcttcaatggaaagatttttcctatactatcaaaactgaagagctaataattactacacacactgccattgggcaagctataagtggagcagctaatacttataaggaaagaaggcaattgacacaactggtcaagcaaggagtgatttcactcgctgattttcaatctgaagagcccaaaatagaatacaccgaattcgagcgagaaacaaaaccaccagttgattgtgtgactaattacaacaatgctgttaagaaccttggcctgtctgaaccagtggatctgccagaatgctcatacgctagaaactctgttcctaacaatgagatatctatggctatgactgatgctgacaacttcgctgttataaatgaaattgaatctctcttgtctgaagaaatcgcagcaccaacacttccagcattgaaaaataaaacatgggctagttatgcatctgacacttcatcaaagaagaatgaagaaattgaaaatataattgctgagctagaagcttcacgtaaggtctccaatgtccagcaaacacagcacaactaccatatctcacaatgccccacttccttaactgctgatcttccatggaaagcctggctcccacttctcaatgcccatggtttcaaaggagatcagatccaacatagtcccgacggccaaataatccaaccaattcaggacatcaacaataaaacaccaagatctgaatacccatctagcatccctgcagatcttgtttcaaccttgcgcaatattaaaagagcagtttatgctattcctatcagccacagaagggccagcgcttatagctcagatgttaaaaataacagaactggaaaactgctctgtgctcaatccaaagaatggaaagagagttttgctttcaaaatgcaacatgaagacatagtcaaatctggtgttgtcatacatggttgtggcggctccggaaaatcacaagcattgcaaaacttccttagaactttgggtgacaataatgactgctgtacagttgttgtccccacagtagagctcaggaatgactgggttaacaaattgtgcaagttgcctatggaacacatcaaaacatttgaaaaagcaatgattcaaccaggctttcctgttgtcatttttgacgactatactaagctgccacccggttacattgaagcttatctgttccatcatgccaacactgaactcttcatcctcactggtgactctagacaaagtgtatatcatgagtccaacaatgaagcttacattgcctctcttgatgaagctgttgcctactattccaactactgtggtttctatttgaacgctacgcacagaaatgtacgtagtttagctaacaagttgggagtgtacagtgaaaaagaaggacacctcaaaattacttttgcatccaatgctctacaaaaatgcaaagtacccatcttggtgccctctcagatgaagaaaaatgcaatgcaagacattggccataaagcaatgacttatgcaggatgtcaaggacttactgctccaagagttcaaattttgcttgacaaccacacacagcattgctcggacagagttctttacacatgtctttcacgagctgtggattctatccattttatcaatactggccccaacaattccgaattttgggataagcttgaagctacaccatacctcaaagcctttattgatacataccgggatgaaaagactgagatgttgaattcaaaacctgcagatgacagccctgtggaacctagagctcctgctactcatttccccgtctctaacggcaacaacttagagaaattagcttcaacactacctgaaaagtttgctcgggagatctatgataaacatcatggttattccaacaccatacaaacagagaaccccatagtacaacttttccaacatcagcaggcaaaagatgaaactctcttttgggcaacaattgaggcaagactttctataaccacaccagatgctaacctcagagaatttactttgaagaaagacgttggagatattctgttctttaactatcactcagcaatgtgtctgccagctgaccctgtcgacttcgagccaagaacttgggaaatatgtgcagctgaagtcaagaatacatacctagcaaaaccaatggctaatttgataaatgccgctagtcgacaatctcctgacttcgagcctaacaagatctcactgtttttgaagtcacaatgggttaagaaagtagagaaattgggagcaatcaaatcaaagcctgggcaaacaattgcggcttttatgcagcaaaccgtcatgctgtacggaactatggctagatacttaagaaaaatgagacaaagatttcaaccaaaacacattttcatcaattgtgaaactacaactgatgatctgaataattttgttctcaatggttggaactttaatcgaactgctcagactaatgatttcactgcatttgatcaatcccaagatggagctatgttacaatttgaagtcatgaaggctaaattcttcaacattcctgcagacgtgattgaagggtatatcaacattaagcttaacgctaaaattttcctaggtaccctttcaattatgaggttatcaggtgaaggtcccacatttgatgcaaacactgaatgctctattgcttacacagcaacaagataccatctaagttcagcagtgaaacaagtttacgctggtgatgacatggctcttgacggagtggtcatggaaaaaccctcctttaagaaactacagagcaagcttaaattgacatcaaaaacattgtttccaaaacaagttaagggtgattatgccgaattttgtgggtggacttttaccccaggtgggattattaaaaatcctttgaaaatgcatgcatccatcatgttacaagaagcaataggtaacctccacactgctgctaggtcgtatgcaatagacatgaagcattcataccaaatgggagataaattgcatgaataccttactcctgatgaagctgagcaacatttcttggctgttcgcaaattgcacaaactccaccaaggtgaagccatgagacttggggagaagagccccccaaaagcaacacattgacgggttaagtttcccctgttcgaaatggaaagatccactctaataaatttacttcaactgcaccactttgaacctaaactcagcgttgaaggagttattgttgtacacggaatcgctggaacagggaaaactaccctacttagaactttattttccgcttacccgaacttagttataggatcacctaggccttgttatttagataaagctaataaaatttcacaagtttgtttatcttgctttccaaacaccctttgtgatattgtcgatgagtaccatcttctagaaagttaccaagaacctactttggctttgtttggagacccttgtcagtgtactttcattgaaagacttagaattccacactacacttccttcagaacacatagatttggcaagtctactgcagagcttttaaacaagttgtttcaacttcaaattgtatctgtaaaacaagaagacgacatagttgaattcttcgacccatttcaagtagacccaactgaaaatatttcagcatctgaggaagaagttttggaatttgtctctgatcaagtagtgacaaccagctctgaagaattagcaggattggagttcactgaaaccactttctactgcactacactagctgcagcagtcactgaaaatcctgccagaactttcatctccttaaccagacacactcagagactcaccattggcgaactaaatgccaggattgactcctagagctgacctcactgacacctacaagataattgctattgcttttttgttgtcagcttgcatttacttccaaaacagccattaccaacctgttgctggagataatctgcatagattgccatttggtggccagtatcaagacggcaccaagaagatatcatattttcctcagcaacaatcatactttcactctggtaacaaattaaatgtcctcatactcatcttcattcttacattgggtatcgtcctcaccaataaatttagttttagcgttagccgtactactcaccagcattcttgctacaatacacattctgcagccaacacaacaccaccattgtcaggtcatcattgacggagctgccatagttgttactaattgtgaaaacacgcctgaagttctaaaagcaatcaacttctccccttggaacgggttaagttttcctagtgtttgaaaattaactttgagcacttcacaattaagctaacaattcactaatcatggctgacaataccccagttgctgctacttctggttcccctccaactgctcaagatgctggtgccaaagcccctgctgacttttcaaatcctaatacagctcctagcctcagtgatttgaagaaagtcaagtatgtgtccacagtcacttcagtggcaacaccaactgaaatagaagcccttggaaagatcttcaccgccatgggactggctgctaatgaaactggacccgctatgtgggatctagcgcgtgcttatgctgatgtccaaagttcaaaatccgcacaactcataggtgccaccccttcaaatccagcactctcacgccgcgcacttgctgcccaatttgatcgtattaacatcacacccaggcagttctgcatgtattttgctaaagttgtctggaacattctgctagacagcaatatcccaccagcaaactgggccaagcttggttaccaagaagacacaaaatttgctgctttcgatttcttcgatggagtcaccaatccagcaagtttgcaaccagctgacggcctcatccgacaacccaatgaaaaggagcttgctgctcactcagttgctaagtatggtgcactagccaggcagaaaatttccactggcaactacataaccacacttggagaggtcacacgtggacacatgggtggagctaacaccatgtacgcaattgatgcacccccagaactttaaaacactcgaaacttaattagagtggggttttctatagtttattttcccaataaattgcttttgtaat

SEQ ID NO: 351 - DNA, 6410 bp, Pepino mosaic virus
gaaaacaaaacaaataaacaaatatacaaagttaaactaacacaacataaccacgtggaaaaacagcgaaagcactttaccacattatgtctcgtgtcagaaatactttggaaaagatcagagacccacaagtacagtccagcatttgtgaagctgcctatcaacatgttcgacctgtacttaaagaatctctaatcaattgtccttacgcgcttaatgattatgaagcagacacccttgagaatcttggtgtcacaattaacccccatgcaatccaaacacacacacatgccgcagccaaagtagtcgaaaatcgtatgcttgaaattgttggacatcacttgcctaaagatgaaaaagtaactttcatcttcctcaaacgtagcaagctgcgttacatgagaagagctgctgtgcataaagatgtctttgtcaatcataacattgaaccaaaagacttcttcaggtatgatgaagagtctacatcaaccagcttttccgttgatacgagaatcgcatacatttcagattctctacactttatggaacctgctgatgtgactcacttgtttgaccgttgccaaaaccttaaaacattgatggcaactgttgtactacctgtggaagctatacacagacagacatctctattccctgcgatttactccattaactacaatgaagaaggctttgagtatatcccaggatcacacggtggtggggcatatttccacaaatatgaaaccctagaatggctcaaatactctagattcattggacatgatccattgactggtttaaaatacaccattacgattcaaatggtggagagtcttggtgccaaccaccttttcctcttccaaagaggaaactttgagacgccgctatacaggacgtttcaaaagaatagttttgtgacattcccaaatatattccatccccgacacgtcaatgccacaaaacctatgcctagatcaagggccatacagctgtacttatatgtgaaatcagtaaataaagttacgcaaagagatatatttgccaaggttagacaactgatttccactgctgagctagaattgtatgaccctgatgaactcacgcatgttgtaaattatttcacatatgtgtcacaactgtcatctatcaatgattatgacaacatgctcaaatccagtttcttcaaaaaactggttgcacccatgcaacacgactggaggtgcatgattgaattcttccggggaaagagtgacttcaatcaactgctcacagctcttcaatggaaagatttttcctatactattaagactgaagagcttgtaattactacacacactgctataggacaagcaataagcaatgcagctgccacatataaagaaagaaagcagctgactcaattggtcaaaaaaggtacaatatccttagcagattttgaacagagagagcctgaaataacttacactgagtttgagcctgaaactaggccccaagtggactgcgttactaattataataatgcagttaaaaatttaggtctttctgcacttgatgaacagccccaatgttcatcttctaacagtcatctaccctgcaatgaaatatccttagcaatgactgatgacgacaatgctgcggccattcatgaaattgaatctctattgtctgaaccgataatagctcctcaactcccagcattgccacacaagacatgggccagttatgcttcagacacttcatccatgaagaaccgtgagattgagaacataattgctgagcttgaaatctcacggaaggaaaataatgtgcagcaaactactcatgattaccatgcagtttctgacacagctcagagctccggagatctcccatggaaagcatggattccacttctgaatgcacacggcttcaagggagaccaacttcaatacagtccggatggcaaagtgattcagccaatccaggacatcaacaacaaaacaccaagatctgagtacccatccagcattcctgcagatcttgtggatacactgcgaaacattaaaagagcagtgtatgccattcctattagccatcgaagggcaagtgcttacagctctgatatcaaaaacaataggaccggcaaattactctgttcccaatcaaaagaatggaaggaaagttttgctttcaaaatgcaacatgaagacatcgttaaatctggagtagtcattcatggctgtggcggctctggaaaatcacaagcattacaaaactttctcagaactcctggcgactctaatgactgctgcacagtggttgtgccaactgttgaactcagaaatgattgggtgaacaaattgtgtaagctacccatggaacacattaaaacatttgaaaaagcaatgattcaaccaggattcccagttgttatctttgatgactacactaaattgccacctggttacattgaagcctatttgttccaccatgccaacactgaacttttcattcttactggggactcgcggcaaagtgtatatcatgagtccaacaatgaagcatacattgcctcattagatgaagccgtcgcttattatgctaactactgtggattttacctaaatgctacacacagaaatgttcgcagtttggccaataagctaggtgtttacagtgagaaagaaggtcacctcaaaattacctttgcctcaaatgctctacaaaagtgcaaagtgccaattttggtgccctctcaaatgaagaagagtgctatgcaagacatagggcacaaagccatgacctacgctgggtgtcaagggcttactgcaccgagagtccaaattttgcttgacaaccacacacaacactgctcagacagggtgctgtacacttgtctctccagagctgtggattccatccactttatcaatacaggcccaaacaattctgaattttgggacaagcttgaggcaacaccatacctcaaagcatttattgatacttacagagatgagaaaacagaaatgctcaattctaagcctgctgatgacagtcccgctgagcctgaagctccattgactcactttccagtgtcaaacggcaataacttggaaaagttagcttcagcgcttcctgaaaaatttgcaagagagttatatgataaacaccatggatattctaatacaatccaaactgaaaatccagtggtgcaacttttccagcatcaacaagccaaagatgaaacacttttctgggcaacaatagaagctagactttctattacaactccggaagccaacttacgagaatttgtgctaaagaaagatgttggagatatcttgtttttcaattaccacaatgtcatgtgcttacctgccgacccagtggatttcgagccaagaacatgggaaatatgtgctgctgaagttaaaaatacatacttagccaaaccaatggctaacttgatcaatgctgctagcagacaatctcctgatttcgacgctaacaaaatttccctgttcctaaaatctcaatgggtcaagaaagtggaaaaattaggtgctgtcaagtcaaagcctggccagaccattgcagctttcatgcaacaaacagtgatgttgtatgggaccatggccagatacctcagaaagatgagacaaagatttcaaccaaaacatattttcatcaattgtgaaacaacaactgataatctgaaccaatttgttaaacaaggttggaattttaacagaacagctcagacaaatgatttcacagcttttgaccaatcacaagatggtgcaatgcttcaatttgaagtcatgaaggcaaaattcttcaatatccctgccgacatcattgaaggatacatcaacatcaaattgaacgccaaaattttccttggcacattgtccattatgaggttgtctggtgaaggtccaacttttgatgccaacacagaatgttcaatagcatatactgctacaagataccatcttgattctacagtcaagcaggtttatgctggagatgatatggcattagatggagttgtccaagaaaaaccctcttttaaaaaactacagaacaagcttaaactcacctcaaagacactatttccaaaacaggttaaaggtgattatgctgaattctgtggttggactttcactcctggtggtatcattaaaaaccctttgaaaatgcatgcttccattatgttgcaagaggcaatcggcaatttacacactgctgccagatcatatgccattgacatgaagcattcataccaaatgggtgatgagctgcacaattacttaacaccagatgaagctgaacaacacttccttgctgttcggaagttgcacaagttacaccaaggagaagcaatgagacttggtgaaaagagccctccaaaagcaacacattgaggggttaagttttccccagttcgaaatggaaagatcaactctgattaatttacttcaattgcaccacttcgagccaaaactcagtgttgaaggaatcatagttgtgcacggaattgcaggcactgggaaaaccactttacttaggactttattttctgcttaccctagcttagttataggttcacctaggccttgctatttagataaacaaaacaaaatttcacaagtttgcttatcttgctttcccaatacccattgtgatattgtcgatgagtatcatttgctagaaagttttccagaaccaaaattggctatctttggtgacccctgtcaatgcacatacattgagagacttagagtcccacattacacttccttcagaactcatagatttggaaagtcaactgctgagattttgaacaaactgtttgaccttaatatagtctcagttaagaaagaagacgacatcgttgaattctttaaccctttcgaagttgaccccactgagcatatctctgcctctgaagaagaagtcttggactttgtttctgaccaagtggtgaccactagctcagaggaactagcaggacttgagtttgcagaaacaactttctactgcacaacattggccgcagctgttgctgaaaatcctgctaagactttcatctctctgactagacacacccacaaactcaccattggggaactaaatgccaggtctaactcctagagctgacctcactgacacatacaaaatcattgccattgctttcttgttgtcagcttgcatttacttccaaaatagccactaccaacctgttgctggagacaacttgcaccgtttgccttttggtggccaatatcaagacggcaccaaaaagatatcttattttccacaacagcagtcatactttcattctggaaacaaattaaatgtcctcatacttatcttcattctcacattgggtattgtcctcaccaataaatttagttttagctttagtcgtactactcaccagcattcttgctataacacacattcagcaaccaacaatacacaaccattgtcaggtcatcattgacggtgctgcaatagtcataacaaattgtgagaacacaccagaagtgcttaaagcaatcaacttctccccttggaacgggttaagttttcctaaatttgaaaattaatattgagtgttcacaaaaatcaacttcaataaacaatcatgcctgacacaacacctgttgctgccacttcaagtgcaccacccacagccaaagatgctggtgccaaagctccttctgacttctcaaatcccaatacagctcctagtctcagtgatttgaagaaagtcaagtatgtctccaccgtgacctccgtggccacaccagctgaaattgaagccctaggcaaaatcttcaccgctatgggccttgccgccaatgagactggtccggccatgtgggatctagctcgtgcatatgctgatgtgcagagttctaaatcggcacagctgattggagctaccccttccaaccctgcactatcacgccgagcccttgctgctcagtttgatcgaatcaatataacccccaggcaattttgcatgtactttgccaaagttgtttggaacatacttctcgacagcaacattccaccagcaaattgggccaaacttggttaccaagaagatacaaaatttgctgcatttgacttcttcgatggagtcaccaaccctgccagcctgcagcctgctgatggtcttatcaggcagccaaatgagaaagaactagctgctcactccgtagctaagtacggcgccttggctaggcaaaagatctccacaggtaattatattaccacacttggagaagtcacacgtggacacatgggaggagctaacaccatgtacgcgatagacgcaccccctgaactttaaacactcgaaacttaatcagagtggggttttctacagtttatcttcctaattatttctttgaaat

SEQ ID NO: 352 - DNA, 6414 bp, Pepino mosaic virus
gaaaacaaaacataaccaaaacaacaaagtcataataacactacataaccacgcggaaaaacagctaacgcactttaccgcattatgtctcgtgttagaaatactttggaaaagatcagagaccctcaagtacagtcaagcatatgcgaagcagcataccaacatgttcgaccagttttgaaggaatctctaatcaattgtccctatgcgctcaatgattatgaagccgacacccttgagaatttaggtgtcacaattaaccctcatgcaattcaaacccatacacacgcagcagctaaagtggttgaaaaccgaatgctagagattgttggtcaccatctaccaaaagatgagaaggttactttcattttcctaaaacgtagtaaattgcgttacatgagaagagctgctgttcataaagatgtttttgtcaaccataacatagagcccaaagatttttttaggtatgacgaggagtctacatcaacaagcttctccgtgaatactagaatcgcatacatttcagattccttacatttcatggagccagctgatgttacacaccttttcgaccgttgccaaaatcttaaaacattaatggcaaccgttgtcctacctgttgaagcaattcatagacaaacatctttatttcctgcgatatactccattaactacaatgaagaaggctttgagtatatccctggttcccacggtggtggggcatactttcacaagtatgagaccttagactggcttaaatattccagattcataggacatgatccattgactggcctcaaatataccattacaattcaaatggttgaaagtctaggcgccaaccaccttttccttttccaaagaggaaattttgaaacgcccttatataggacctttcaaaaaaatagttttgtgacattccctaatatatttcatccccgacatgtcaatgccacaaaacctatgccacgctccagggcaatccaattgtacttatatgttaagtctgtcaacaaagtcacacaaagagacatctttgcaaaagttagacagcttatatccacagctgagctggaactgtatgaccctgatgagcttactcatgttgtcaattacttttcctatgtttcacaattgtcatctataaatgattatgacaacatgctaaaatccagtttcttcaagaaattggttgcacccatgcaacacgactggaggtgcatgattgaattcttccggggaaagagtgatttcaatcaacttctcaccgctcttcaatggaaagatttttcctatactatcaaaactgaagagctaataattactacacacactgctattgggcaagctataagtggagcagctaatacttataaggaaagaaggcaattgacacaactggtcaagcaaggagtgatttcactcgctgattttcaatctgaagagcccaaaatagaatataccgaattcgagcgagaaacaaaaccaccagttgattgtgtgactaattacaacaatgctgttaagaaccttggcctgtctgaaccagtggatctgccagaatgctcatacgctagaaactccgttcctaacaatgagatatctatggctatgattgatgctgacaacttcgctgttataaatgaaattgaatctctcttgtctgaagaaatcgcagcaccaacacttccagcattgaaaaataaaacatgggctagttatgcatctgacacttcatcaaagaagaatgaagaaattgaaaatataattgctgagctagaagcttcacgtaaggtctccaatgtccagcaaacacagcacaactaccatatctcacaatgccccacttccttaactgctgatcttccatggaaagcctggctcccacttctcaatgcccatggtttcaaaggagatcagatccaacatagtcccgacggccaaataatccaaccaattcaggacatcaacaataaaacaccaagatctgaatacccatctagcatccctgcagatcttgtttcaaccttgcgcaatattaaaagagcagtttatgccattcctatcagccacagaagggccagcgcttatagctcagatgttaaaaataacagaactggaaaactgctctgtgctcaatccaaagaatggaaagagagttttgctttcaaaatgcaacatgaagacatagtcaaatctggtgttgtcatacatggttgtggcggctccggaaaatcacaagcattgcaaaacttccttagaactttgggtgacaataatgactgctgtacagttgttgtccccacagtagagctcaggaatgactgggttaacaaattgtgcaagttgcctatggaacacatcaaaacatttgaaaaagcaatgattcaaccaggttttcctgttgtcatttttgacgactatactaagctgccacccggttacattgaagcttatctgttccatcatgccaacactgaactcttcatcctcactggtgactctagacaaagtgtatatcatgagtccaacaatgaagcttacattgcctctcttgatgaagctgttgcctactattccaactactgtggtttctatttgaacgctacgcacagaaatgtacgtagtttagctaacaagttgggagtgtacagtgaaaaggaaggacacctcaaaattacttttgcatccaatgctctacaaaaatgcaaagtacccatcttggtgccctctcagatgaagaaaaatgcaatgcaagacattggccataaagcaatgacttatgcaggatgtcaaggacttactgctccaagagttcaaattttgcttgacaaccacacacagcattgctcggacagagttctttacacatgtctttcacgagctgtggattctatccattttatcaatactggccccaacaattctgaattttgggataagcttgaagctacaccatacctcaaagcctttattgatacataccgagatgaaaagactgagatgttgaactcaaaacctgcagatgacagccctgtggaacctgaagctcctgctactcatttccccgtctctaacggcaacaacttagagaaattagcttcaacactacctgaaaagtttgctcgggagatctacgataaacatcatggttattccaacaccatacaaacagagaaccccatagtacaacttttccaacatcagcaggcaaaagatgaaactctcttttgggcaacaattgaggcaagactttctataaccacaccagatgctaacctcagagaatttactttgaagaaagacgttggagatattctgttctttaactatcactcagcaatgtgtctgccagctgaccccgtcgacttcgagccaagaacttgggaaatatgtgcagctgaagtcaagaatacatacctagcaaaaccaatggctaatttgataaatgccgctagtcgacaatctcctgacttcgagcctaacaagatctcactgtttttgaagtcacaatgggttaagaaagtagagaaattgggagcaatcaaatcaaagcctgggcaaacaattgcggcttttatgcagcaaactgttatgctgtacggaactatggctagatacttaagaaaaatgagacaaagatttcaaccaaaacacattttcattaattgtgaaactacaactgatgatctgaataattttgttctcaatggttggaactttaatcgaactgctcagactaatgatttcactgcatttgatcaatcccaagatggagctatgttacaatttgaagtcatgaaggctaaattcttcaacattcctgcagacgtcattgaagggtatatcaacattaagcttaacgctaaaattttcctaggtaccctttcaattatgaggttatcaggtgaaggtcccacatttgatgcaaacactgaatgctctattgcttacacagcaacaagataccatctgagttcagcagtgaaacaagtttacgctggtgatgacatggctcttgacggagtggtcatggaaaaaccctcctttaagaaattacagagcaagcttaaattgacatcaaaaacattgtttccaaaacaagttaagggtgattatgccgaattttgtgggtggacttttaccccaggtgggattattaaaaatcctttgaaaatgcatgcatccatcatgttacaagaagcaataggtaatctccacacttctgctaggtcgtatgcaatagacatgaagcattcataccaaatgggagataaattgcatgaataccttactcctgatgaagctgagcaacatttcttggctgttcgcaaattgcacaaactccaccaaggtgaagccatgagacttggggagaagagccccccaaaagcaacacattgacgggttaagtttcccctgttcgaaatggaaagatccactctaataaatttacttcaactgcaccactttagacctaaactcagcgttgaaggagttattgttgtacacggaatcgctggaacagggaaaactaccctacttagaactttattttccgcttacccgaacttagttataggatcacctaggccttgttacttagataaagccaataatatttcacaagtttgtttatcttgctttccaaacaccctttgtgatattgtcgatgagtaccatcttctagaaagttaccaagaacctactttggctttgtttggcgacccttgtcagtgtactttcattgaaagacttagaattccacactacacttccttcagaacacatagatttggcaagtctactgcagagcttttaaacaagttgtttcaacttcaaattgtctctgtaaaacaagaagacgacatagttgaattctttgacccatttcaagtagacccaactgaaaatatttcagcatctgaggaagaagttttggaatttgtctctgatcaagtagtgacaaccagctctgaagaattagcaggattggagttcactgaaaccactttctactgcactacactagctgcagcagtcactaaaaatcctgccagaactttcatctccttaaccagacacactcagaaactcaccattggcgaactaaatgccaggattgactcctagagctgacctcactgacacctacaagataattgctattgcttttttgttgtcagcttgcatttacttccaaaacagccattaccaacctgttgctggagataatctgcatagattaccatttggtggccagtatcaagacggtaccaagaagatatcatattttcctcagcaacaatcatactttcactctggtaacaaattaaatgtcctcatactcatcttcattcttacattgggtatcgtcctcaccaataaatttagttttagcgttagccgtactactcaccagcattcttgctacaatacacattctgcagccaacacaacaccaccattgtcaggtcatcattgacggagctgccatagttgttactaattgtgaaaacacgcctgaagttctaaaagcaatcaacttctccccttggaacgggttaagttttcctagtgtttgaaaattaactttgagcacttcacaattaagctaacaattcactaatcatggctgacaataccccagttgctgctacttctggttcccctccaactgctcaagatgctggtgccaaagcccctgctgacttttcaaatcctaatacagctcctagcctcagtgatttgaagaaagtcaagtatgtgtccacagtcacttcagtggcaacaccaactgaaatagaagcacttggaaagatcttcaccgccatgggactggctgctaatgaaactggacccgctatgtgggatctagcgcgtgcttatgctgatgtccaaagttcaaaatccgcacaactcataggtgccaccccttcaaatccagcactctcacgccgcgcacttgctgcccaatttgatcgtattaacatcacacccaggcagttctgcatgtattttgctaaagttgtctggaacattctgctagacagcaatatcccaccagcaaactgggccaagcttggttaccaagaagacacaaaatttgctgctttcgatttcttcgatggagtcaccaatccagccagtttgcaaccagctgacggcctcatccggcaacccaatgaaaaggagcttgctgctcactcagttgctaagtatggtgcactagccaggcagaaaatttccactggcaactgcataaccacacttggagaggtcacacgtggacacatgggtggagctaacaccatgtacgcaattgatgcacccccagaactttaaaacactcgaaacttaattagagtggggttttctatagtttattttcccaataaattgcttttgtaattt

SEQ ID NO: 353 - DNA, 6412 bp, Pepino mosaic virus
gaaaacaaaacataacacataatatcaaaagtgaccaaacacaacataaccacgtggaaaaacagcgaaagcactttaccacattatgtctcgtgttagaaacactttagaaaagatcagggacccacaagtacaatctagcatttgtgaagccgcttaccaacatgttagacctgtgctcaaggaatccctaatcaactgtccttatgcgctcaatgactatgaagcagacacccttgagaatttaggtgtcacaataaatccccatgcaatccaaacacatactcatgcagcagctaaagttgtggaaaatagaatgctcgaaattgttggacaccacttgcccaaggacgagaaagttaccttcattttcctcaaaagaagcaaactgagatacatgcgaagagctgctgtacataaagatgtttttgttaatcacagtatagaacccaaggatttcttcaggtatgacgaggaatctacatctactagcttctccgtgaacactaggatcgcttacatctcagattctctacatttcatggaaccagctgatgtgacccacctcttcgaccgttgccacaatcttaaaacactgatggcaactgttgttttacctgttgaagccatccacaaacaaacatctttatttccagcgatatactccattaactacaatgaagaaggttttgagtatatccctggttctcatggtggaggggcatactttcataagtatgaaacattagactggctcaaatactctagattcgttggccaggaccccttaactggactccgatacaccataaccattcaaatggtggagagtttaggagccaaccaccttttcctcttccaaagaggaaactttgaaacgcctttatataggacgtttcaaaaaaatagctttgtgacctttcctaacatcttccatccccaacatgttaatgccacaaagcccatgccaagatccagggcaattcagctgtatttatatgtcaaatctgtcaataaggtgacacaaagagatatctttgcgaaagtaaggcaacttatatctacagctgaacttgaattgtatgaccctgatgaacttacacatattgtcaattatttcgcatatgtctcagaactaagctcaatcaacgactatgacaatatgctcaaatcaagttttttcaaaaaacttgttgcacccatgcaacatgactggaggtgcatgattgaattctttcggggaaaaagtgatttcaatcaacttttaactgctcttcaatggaaagacttctcttacactattaaaactgaagagttagttgtttctacacacactgaaattggccaggcaatctgtaaagctgcgaccatatacaaagaaagaagacaattgaccaatttagtcaaacaaggcgtagtaacattagctgatttcaaagaagcggaccagcaagtggagtacactcactttgatcctgagtttaaatccactgttgaaccccaccggagctatgaaaatgccatcaacaatcttggcattgaaattaatgaggatgtacctgaaagttccggcactaatgaaacattgcttaacaatgaaatatctttagcaatgtcatctgctgaacatgtgcaagccgttcaagaaattgagtctttactctctaaccccgaagcggcgccaatattgccccctgcgcatgttaaaacatgggctagccttgcatctgacacttccagcactaaaaaccgtgaaattgaagatatagtggctaagctggaaatacaaagaaatgaagctagttgcagctaccttcaaccaaataaggaattgtcaaaacccaaggctgctgataacaatctcccctggaatgcttggatcccattgcttaatgcacacggcttcaaaggagatcaattacaatacggcccagatggcaacttgatacagcccatccaagacattaacaattcacagcctagatctgactatccgtcttctctgccatgtgaacttgtggaaactttgaggaaaattaagcgtgctgtctatgccatcccaataagccacaggagggctagtgcttacagttctgacatcaaaaataacagaactggcaaacttctctgcaaccaaagcaaagaatggaaagaaagctttgctttcaaaatgcaacacgaagacatcgtcaaatcaggtgttgtcatacatggttgcggaggttctggcaaatcccaggcattacaaaacttcttgagaacattgggtgattcaaatgattgctgtactgttgtagtacccactgttgaacttagaaatgactgggtaaacaaactccataaattgcccatggagcacatcaaaacatttgagaaagcaatgattcaacctggctttccaattgttatatttgatgattacaccaagttacctcctggctacattgaagcctacctatttcaccatgccaacactgagcttttcatacttactggtgattctaggcaaagcgtgtatcatgaatctaacaatgaagcgtacattgcctcattagatgaagctgttgcatactacgctaattactgcggtttttacttaaatgctactcatagaaatgtccgtagtttagccaataaacttggtgtttacagtgagaaagaaggacacttgaaaatcactttcgcttcacatgccttacaaaagtgcaaagtgccaattctagttccttctcaaatgaaaaagagtgctatgttagacattggacataaatccatgacctatgctggttgccaaggtttaacagcacccaaagtacaaattctccttgataatcacacgcaacattgctctgacagagttctgtacacctgtttgtctcgtgcagttgattccatccacttcatcaatactggtcccaacaattcagaattttgggataagcttgaagcaacaccatatctcaaagccttcattgatgtctatagagatgaaaaaactgaaatgctcaattctaagcctgctgatgatagtccaactgagcctgaagcacctgttacacatttcccaatagcaaatggaaataacttagagaaattagcttctgctttgcctgaaaaatttgctagggagatttatgacaagcatcatggctactccaacacaatccaaactgagaaccctgtggtccaacttttccaacatcaacaagcgaaagacgagacactcttctgggctacaattgaagctagattgtccataacaactcctgaagcaaacctcagagaatttttgcttaagaaagatgttggggacattctcttcttcaattaccacaatgcgatgtgcttgcctgccgaccctgttgactttgaagaaaagacctgggagatttgtgctgctgaagtgaaaaacacttatcttgccaaacccatggccaatcttattaatgcggcaagtagacaatcacccgactttgactccaataagatctcattattcctaaagtctcaatgggtgaaaaaagtggaaaaacttggagctatcaaatcaaaacctggtcagaccatagctgcttttatgcaacaaacagtcatgttgtatggtactatggccaggtacttaaggaaaatgcggcaaagattccagccaaaacacatattcatcaattgtgaaaccacaactgatgatctcaataaatttgtcaaagacggctggaactttaacagaaccgcccaaacaaatgacttcactgcttttgaccagtcacaagatggagcaatgcttcaatttgaagtcatgaaagcaaaattttttaacattccagctgatgtcattgaaggctacatcaacatcaagctgaatgctaaaattttccttggaacactctcaataatgagactttctggtgaaggtcccacatttgacgctaacactgagtgttcgattgcatacactgccacaagattccatattgacaatactgttaagcaagtgtatgccggtgacgacatggcgttagatggagttgtgagtgaaaagaaatcattcaggaagttgcaaaatctactaaaactcacttcaaaaacgctgtacccaaaacaggttaaaggggattacgctgaattttgcggttggacattcacaccagggggtataattaaaaatccacttaaaatgcatgcctcaattatgctgcaagaagccattggcaatctgcacacagcagccagatcttatgcaatcgacatgaagcattcataccaaatgggtgaccaactgcacgactacctaaccctcgatgaagctgaacaacatttcctagctgtgagaaagcttcacaaactccatcaaggcgaggccatgcgtcttggggagaaaagtccaccaagatcaacccattaaggggttaagttttccccagtttgaaatggaaagatcaactttgatcaatttacttctgttacacaaatttgaacacaagattaacactgaaggaatcattgttgtgcacggaattgctggaactgggaaaaccacattgcttaggactttattttctgcataccctagcttagttataggttcacctaggccttgttacttagataaagctaataaaatttcacaggtttgcctttcttgttttccaaataccttgtgtgacattgttgacgagtaccatctcttagaaagttttcttgaaccaaaactagccatttttggtgacccctgtcagtgcacttacattgaaaggttgagaatacccaactatacatccttcagaacacaccgatttggcaaatccactgctgctctactaaacaagttatttgatcttaacattgagtcagtcaaagtacaaggcgacacagtagaatactttgatcctttcgcagtggacccctctgaacacatttctgcttcagaaaaagaagttttggaatttgtaggtgatcaagttgagactacaagctctgaagaactagctggtttcgagtttagtgaagttactttctactgtaccacacttgctggtgctgttcaagaaaatcctgccaaaaccttcatttcacccactagacacacttcaaagctcagaattggtgaactaaatgccaggtctgactcctagagctgatcttactgacacgtacaaaatcattgctatagcctttctactgtcagcttgcatttacttccaaaacagtcattatcaaccagttgcaggtgataatttgcacagactacccttcggtggtcagtatcaagacggaactaagaagatttcttactttccgcagcaacaatcttactttcactcaggaaacaagcttaatgtcctcatacttatcttcattcttacactgggtattgtcctcaccaatcaatttagttttagcattagccgtaatattcaccagcatcattgctacaacacacattctgcaacccaaacaggtcaatcagtgccaggtcatcattgacggtgcagccatagttataacaaattgtccaaacacacccgaagttcttaaagcaatcaacttctccccttggaacgggttaagttttcctcaattgtgaaatcatattcattatctagttaaatttaaacaatttaactcaactatggaaaaccaacctacagcttctaacccatcagatgcaccaccaactgctgctcaagctggtgcccagagcccagccgacttctcaaatcctaatacagctccttccctaagtgatttgaagaagatcaaatacgtgtcaactgtcacttcagttgccacgcctgctgaaattgaagcccttggcaagatctttactgccatgggtttagcagccaatgagaccggacctgccatgtgggacctcgctcgtgcttatgctgatgtgcaaagttcaaaatctgcacaacttataggtgccacaccatccaaccctgctttgtctagacgtgcacttgctgcacagtttgatcgtatcaatatcacacccagacaattctgcatgtattttgcaaaaattgtttggaacatactgttagacagcaatgtgccacctgccaactgggcaaaattgggctatcaggaagataccaagtttgctgcttttgacttctttgatggagtcacaaacccagctagtctacagcctgcagatggcctaattaggcagcccaatgaaaaagagcttgctgctcactcggttgctaaatatggtgcccttgcccgccagaaaatatccactggtaactacatcaccacccttggtgaagttacacgtggtcacatgggcggcgccaacactatgtacgcaattgatgcacctcctgaactttaaacactcgaaacttaatcagagtggggttttctatagtttattttcccttagtatctaaatctactaaat

SEQ ID NO: 354 - DNA, 6408 bp, Pepino mosaic virus
gaaaacaaaacataaccaaaacaacaaagtcataataacactacataaccacgcggaaaaacagctaacgcactttaccgcattatgtctcgtgttagaaatactttggaaaagatcagggacccacaagtacaatctagcatttgtgaagccgcttaccaacatgttagacctgtgctcaaggaatccctaatcaactgtccttatgcgcttaatgactatgaagcagacacccttgagaatttaggtgtcacaataaacccccatgcaatccaaacacatactcatgcggcagctaaagttgtggaaaatagaatgctcgaaattgttggacaccacttgcccaaggacgagaaagttaccttcattttcctcaaaagaagcaaactgagatacatgcgaagagctgctgtacataaagatgtttttgttaatcacaatatagaacccaaggatttcttcaggtatgatgaggaatctacatctactagtttctccgtgaacaccaggatcgcttacatctccgattctctacatttcatggaaccagctgatgtgacccacctctttgaccgttgccacaatcttaaaacactgatggcaactgttgttttacctgttgaagccatccacaaacaaacatctttattcccagcgatatactccattaattacaatgaagaaggttttgagtatatccctggttctcatggtggaggggcatactttcataagtatgaaacattagactggctcaaatactctagattcgttggccaggaccccttaactggactccgatacaccataaccattcaaatggtggagagtttaggagccaaccatcttttcctcttccaaagaggaaattttgaaacacctttatacaggacgtttcaaaaaaatagctttgtgacctttcctaacatcttccatccccaacatgttaatgccacaaagcccatgccaagatccagggcaattcagctgtatttatatgtcaaatctgtcaataaggtgacacaaagagatatctttgcgaaagtaaggcaacttatatctacagctgaacttgaattgtatgaccctgatgaacttacacatattgtcaattatttcgcatatgtctcagaactaagctcaatcaacgactatgacaatatgctcaaatcaagttttttcaaaaaacttgttgcacccatgcaacatgactggaggtgcatgattgaattctttcggggaaaaagtgatttcaatcaacttttaactgctcttcaatggaaagacttctcttacaccattaaaactgaagagttagttattgctacacacactgaaattggccaggcaatctgtaaagctgcgaccacatacaaagaaagaagacaattgaccaatttagtcaaacaaggcgcagtaacattagctgatttcaaagaagcggaccagcatgtggagtacactcactttgatcctgagtttaaatccactgttgacccccaccggagctatgaaaatgccatcaacaatcttggcattgagattaatgaggatgtacctgaaagttccggcactaatgaaacattgcttaacaatgaaatatctttagcaatgtcatctgctgaacatgtgcaagctgttcaagaaattgagtctttactctctaaccccgaagcggcaccaatattgccccctgcacatgttaaaacatgggctagccttgcatctgacacttccagcactaaaaaccgtgaaatcgaagatatagtggctaagctggaaatacaaagaaatgaagctagttgcagctaccttcaaccaaataaggaattgtcaaaacccaaggctgctgataacaatctcccctggaatgcttggatcccattgcttaatgcacacggcttcaaaggagatcaattacaatacggcccagatggtaacttgatacagcccatccaagacattaacaattcacagcctagatctgactatccgtcttctctgccatgtgagcttgtggaaactttgaggaaaattaagcgtgctgtctatgccatcccaataagccacaggagggctagtgcttacagttctgacatcaaaaataacagaactggcaaacttctctgcaaccaaagcaaagaatggaaagaaagctttgctttcaaagtgcaacatgaagacatcgtcaaatcaggtgttgtcatacatggttgcggaggttctggcaaatcccaggcattacaaaacttcttgagaacattgggtgattcaaatgattgctgtactgttgtagtacccactgtagagctcaggaatgactgggttaacaaattgtgcaagttgcctatggaacacatcaaaacatttgaaaaagcaatgattcaaccaggctttcctgttgtcatttttgacgactatactaagctgccacccggttacattgaagcttatctgttccatcatgccaacactgaactcttcatcctcactggtgactctagacaaagtgtatatcatgagtccaacaatgaagcttacattgcctctcttgatgaagctgttgcctactattccaactactgtggtttctatttgaacgctacgcacagaaatgtacgtagtttagctaacaagttgggagtgtacagtgaaaaagaaggacctcaaaattacttttgcatccaatgctctacaaaaatgcaaagtacccatcttggtgccctctcagatgaagaaaaatgcaatgcaagacattggccataaagcaatgacttatgcaggatgtcaaggacttactgctccaagagttcaaattttgcttgacaaccacacacagcattgctcggacagagttctttacacatgtctttcacgagctrtggattctatccattttatcaatactggccccaacaattccgaattttgggataagcttgaagctacaccatacctcaaagcctttattgatacataccgggatgaaaagactgagatgttgaattcaaaacctgcagatgacagccctgtggaacctgaagctcctgctactcatttccccgtctctaacggcaacaacttagagaaattagcttcaacactacctgaaaagtttgctcgggagatctatgataaacatcatggttattccaacaccatacaaacagagaaccccatagtacaacttttccaacatcagcaggcaaaagatgaaactctcttttgggcaacaattgaggcaagactttctataaccacaccagatgctaacctcagagaatttactttgaagaaagacgttggagatattctgttctttaactatcactcagcaatgtgtctgccagctgaccctgtcgacttcgagccaagaacttgggaaatatgtgcagctgaagtcaagaatacatacctagcaaaaccaatggctaatttgataaatgccgctagtcgacaatctcctgacttcgagcctaacaagatctcactgtttttgaagtcacaatgggttaagaaagtagagaaattgggagcaatcaaatcaaagcctgggcaaacaattgcggcttttatgcagcaaaccgtcatgctgtacggaactatggctagatacttaagaaaaatgagacaaagatttcaaccaaaacacattttcatcaattgtgaaactacaactgatgatctgaataattttgttctcaatggttggaactttaatcgaactgctcagactaatgatttcactgcatttgatcaatcccaagatggagctatgttacaatttgaagtcatgaaggctaaattcttcaacattcctgcagacgtgattgaagggtatatcaacattaagcttaacgctaaaattttcctaggtaccctttcaattatgaggttatcaggtgaaggtcccacatttgatgcaaacactgaatgctctattgcttacacagcaacaagataccatctgagttcagcagtgaaacaagtttacgctggtgatgacatggctcttgacggagtggtcatggaaaaaccctcctttaagaaactacagagcaagcttaaattgacatcaaaaacattgtttccaaaacaagttaagggtgattatgccgaattttgtgggtggacttttaccccaggtgggattattaaaaatcctttgaaaatgcatgcatccatcatgttacaagaagcaataggtaacctccacactgctgctaggtcgtatgcaatagacatgaagcattcataccaaatgggagataaattgcatgaataccttactcctgatgaagctgagcaacatttcttggctgttcgcaaattgcacaaactccaccaaggtgaagccatgagacttggggagaagagccccccaaaagcaacacattgacgggttaagtttcccctgttcgaaatggaaagatccactctaataaatttacttcaactgcaccactttgaacctaaactcagcgttgaaggagttattgttgtacacggaatcgctggaacagggaaaactaccctacttagaactttattttccgcttacccgaacttagttataggatcacctaggccttgttatttagataaagctaataaaatttcacaagtttgtttatcttgctttccaaacaccctttgtgatattgtcgatgagtaccatcttctagaaagttaccaagaacctactttggctttgtttggagacccttgtcagtgtacttacattgaaaggttgagaacacccaactacacatccttcagaacacaccgatttggcaaatccactgctgctctactaaacaagttatttgatcttaacattgagtcagtcaaagcacaagacgacacagtagaatactttgatcctttcgcagtggacccctctgaacacatttctgcttcagaaaaagaagttttggaatttgtaggtgatcaagttgagactacaagctctgaagaactagctggtctcgagtttagtgaagttactttctactgtaccacacttgctggtgctgttcaagaaaatcctgccaaaaccttcatttcactcactagacacacttcaaagctcacaattggtgaactaaatgccaggtctgactcctagagctgatcttactgacacgtataaaatcattgctatagcctttctactgtcagcttgcatttacttccaaaacagtcattatcaaccagttgcaggtgataatttgcacagactaccctttggtggtcagtatcaagacggaactaagaagatttcttactttccgcagcaacaatcctactttcactcaggaaacaagcttaatgtcctcatactcatcttcattcttacattgggtattgtcctcaccaataaatttagttttagcattagccgtaatactcaccagcatcattgctacaacacacattctgcaacccaaacaggtcaatcagtgccaggtcatcattgatggtgcagccatagttataacaaattgtccaaacacacccgaagttcttaaagcaatcaacttctccccttggaacgggttaagttttcctcaattgtgaaatcatacttgttatctagttaaattcaaacaatttaactcaactatggaaaaccaacctacagcttctaacccatcagatgcaccaccaactgctgctcaagctggtgcccagagcccagccgacttctcaaatcctaatacagctccttccctaagtgatttgaagaagatcaaatacgtgtcaactgtcacttcagttgccacgcctgctgaaattgaggcccttggcaagatctttactgccatgggtttagcagccaatgagaccggacctgccatgtgggacctcgctcgtgcttatgctgatgtgcaaagttcaaaatctgcacaacttataggtgccacaccatccaaccctgctttgtctagacgtgcacttgctgcacagtttgatcgtatcaatatcacacccagacaattctgcatgtattttgcaaaaattgtttggaacatactgttagacagcaatgtgccacctgccaactgggcaaaattgggctatcaggaagataccaagtttgctgcttttgacttctttgatggagtcacaaatccagctagtctacagcctgcagatggcctaatcaggcagcccaatgaaaaagagcttgctgctcactcggttgctaaatatggtgcccttgcccgccagaaaatatccactggtaactacatcaccacccttggtgaagttacacgtggtcacatgggcggcgccaacactatgtacgcaattgatgcacctcctgaactttaaacactcgaaacttaatcagagtggggttttctatagtttattttcccttagtatctaaatctactaaat

SEQ ID NO: 355 - DNA, 6412 bp, Pepino mosaic virus
gaaaacaaaacataacacataatatcaaaagtgacctaacacaacataaccacgtggaaaaacagcgaaagcactttaccacattatgtctcgtgttagaaacactttagaaaagatcagggacccacaagtacaatctagcatttgtgaagccgcttaccaacatgtcagacctgtgctcaaggaatccctaatcaactgtccttatgcgcttaatgactatgaagcagacacccttgagaatttaggtgtcacaataaacccccatgcaatccaaacacatactcatgcggcagctaaagttgtggaaaatagaatgctcgaaattgttggacaccacttgcccaaggacgagaaagttaccttcattttcctcaaaagaagcaaactgagatacatgcgaagagctgctgtacataaagatgtttttgttaatcacaatatagaacccaaggatttcttcaggtatgatgaggaatctacatctactagtttctccgtgaacaccaggatcgcttacatctccgattctctacatttcatggaaccagctgatgtgacccacctctttgaccgttgccacaatcttaaaacactgatggcaactgtcgttttacctgttgaagccatccacaaacaaacatctttatttccagcgatatactccattaattacaatgaagaaggttttgagtatatccctggttctcatggtggaggggcatactttcataagtatgaaacattagactggctcaaatactctagatttgttggccaggaccccttaactggactccgatacaccataaccattcaaatggtagagagtttaggagccaaccatcttttcctcttccaaagaggaaattttgaaacacctttatacaggacgtttcaaaaaaatagctttgtgacctttcctaacatcttccatccccaacatgttaatgccacaaagcccatgccaagatccagggcaattcagctgtatttatatgtcaaatctgtcaataaggtgacacaaagagatatctttgcgaaagtaaggcaacttatatctacagctgaacttgaattgtatgaccctgatgaacttacacatattgtcaattatttcgcatatgtctcagaactaagctcaatcaacgactatgacaatatgctcaaatcaagttttttcaaaaaacttgttgcacccatgcaacatgactggaggtgcatgattgaattctttcggggaaaaagtgatttcaatcaacttttaactgctcttcaatggaaagacttctcttacaccattaaaactgaagagttagttgttgctacacacactgaaattggccaggcaatctgtgaagctgcgaccacatacaaagaaagaagacaattgaccaatttagtcaaacaaggcgcagtaacattagctgatttcaaagaagcggaccagcatgtggagtacactcactttgatcctgagtttaaatccactgttgacccccaccagagctatgaaaatgccatcaacaatcttggcattgaaattaatgaggatgtacctgaaagttccggcactaataaaacattgcttaacaatgaaatatctttagcaatgtcatctgctgaacatgtgcaagctgttcaagaaattgagtctttactctctaaccccgaagcggcaccaatattgccccctgcacatgttaaaacatgggctagccttgcatctgacacttccagcactaaaaaccgtgaaatcgaagatatagtggctaagctggaaatacaaagaaatgaagctagttgcagctaccttcaaccaaataaggaattgtcaaaacccaaggctgctgataacaatctcccctggaatgcttggatcccattgcttaatgcacacggcttcaaaggggatcaattacaatacggcccagatggtaacttgatacagcccatccaagacattaacaattcacagcctagatctgactatccgtcttctctgccatgtgaacttgtggaaactttgaggaaaattaagcgtgctgtctatgccatcccaataagccacaggagagctagtgcttacagttctgacatcaaaaataacagaactggcaaacttctctgcaaccaaagcaaagaatggaaagaaagctttgctttcaaaatgcaacatgaagacatcgtcaaatcaggtgttgtcatacatggttgcggaggttctggcaaatcccaggcattacaaaacttcttgagaacattgggtgattcaaatgattgctgtactgttgtagtacccactgttgaacttagaaatgactgggtaaacaaactccataaattgcccatggagcatatcaaaacatttgagaaagcaatgattcaacctagctttccaattgttatatttgatgattacaccaagttgccacctggctacattgaagcatacttatttcaccatgccaacactgagcttttcatacttactggtgattctaggcaaagcgtgtaccatgaatctaacaatgaagcgtacattgcctcattagatgaagctgttgcatactacgctaattactgcggtttttatttaaatgctactcatagaaatgtccgtagtttggccaacaaacttggtgtttacagtgagaaagaaggacacttgaaaatcacttttgcttcacatgccttacaaaagtgcaaagtgccaattttagttccttctcaaatgaaaaagagtgctatgttagacattggacataaatccatgacctatgctggttgccaaggtttaacagcacccagggtacaaattctccttgataaccacacgcaacattgctctgacagagttctgtacacctgtctgtctcgtgcagttgattccatccatttcatcaatactggtcccaacaattcagaattttgggataagcttgaagcaacaccatatctcaaagccttcattgatgtctatagagatgaaaaaactgaaatgctcaattctaagcctgctgatgacagtccaactgagcctgaagcacctgttacacatttcccaatagcaaatggaaataacttagagaaattagcttctgctttgcctgaaaaatttgctagggagatttatgaccagcatcatggccactccaacacaatccaaactgagaaccctgtggtccaacttttccaacatcaacaagcgaaagacgagacactcttttgggctacaattgaagctagattgtccataacaactcctgaagcaaacctcagagaatttttgcttaagaaagatgttggagacattctcttcttcaattaccataatgcgatgtgcttgcctgccgatcctgtggactttgaagaaaagacctgggagatctgtgctgctgaagtgaaaaacacttatcttgccaaacccatggccaatcttatcaatgcggcaagtagacaatcacccgactttgactctaataagatctcattattcctaaagtctcaatgggtgaaaaaagtggaaaaacttggagctatcaaatcaaaacctggtcagaccatagctgcttttatgcaacaaacagtcatgttgtatggtactatggccaggtacttaaggaaaatgcggcaaagattccagccaaaacacatattcatcaattgtgaaaccacaactgatgatctcaataaatttgtcaaagatggctggaactttaacagaaccgcccaaacaaatgacttcactgcttttgatcagtcacaagatggagcaatgcttcaatttgaagtcatgaaagcaaaattttttaacattccagctgatgtcattgaaggctacatcaacatcaagctgaatgctaaaattttccttggaacactctcaataatgagactttctggtgaaggtcccacatttgacgctaacactgagtgttcgattgcatacactgccacaagattccatattgacaatactgttaagcaagtgtatgccggtgacgacatggcattagatggagttgtgagtgaaaagaaatcattcaggaagttacaaaatctactaaaactcacttcaaaaacgctgtacccaaaacaggttaaaggggattacgctgaattttgtggttggactttcacaccagggggtataattaaaaatccacttaaaatgcatgcctcaattatgctgcaagaagccattggcaatctgcacacagcagccagatcttatgcaattgacatgaagcattcataccaaatgggtgaccaactgcatgactacctaacccccgatgaagctgaacaacatttcctagctgtgagaaagcttcacaaactccatcaaggcgaggccatgcgtcttggggagaaaagtccaccaagatcaacccattaaggggttaagttttccccagtttgaaatggaaagatcaactttgatcaatttacttctgttacacaaatttgaacacaagattaacactgaaggaatcattgttgtgcacggaattgctggaactgggaaaaccacattgcttaggactttattttccgcataccctagcttagttataggttcacctaggccttgttacttagataaagctaataaaatttcacaagtttgcctttcttgttttccaaataccttgtgtgacattgttgacgagtatcatctcttagaaagttttcctgaaccaaaactagccatttttggtgacccctgtcagtgcacttacattgaaaggttgagaacacccaactacacatccttcagaacacaccgatttggcaaatccactgctgctctactaaaccagttatttgatcttaacattgagtcagtcaaagcacaagacgacacagtagaatactttgatcctttcgcagtggacccctctgaacacatctctgcttcagaaaaagaagttttggaattcgtaggtgatcaagttgagactacaagctctgaagaactagctggtctcgagtttagtgaagttactttctactgtaccacacttggcggtgctgttcaagaaaatcctgccaaaaccttcatttcactcactagacacacttcaaagctcacaattggtgaactaaatgccaggtctgactcctagagctgatcttactgacacgtataaaatcattgctatagcctttctactgtcagcttgcatttacttccaaaacagtcattatcaaccagttgcaggtgataatttgcacagactaccctttggtggtcagtatcaagacggaactaagaagatttcttactttccgcagcaacaatcctactttcactcaggaaacaagcttaatgtcctcatacttatcttcattcttacactgggtattgtcctcaccaataaatttagttttagcattagccgtaatactcaccagcatcattgctacaacacacattctgcaacccaaacaggtcaatcagtgccaggtcatcattgacggtgcagccatagttataacaaattgtccaaacacaccagaagtgcttaaagcaatcaacttctccccttggaacgggttaagttttcctcaattgtgaaattatatttgttatctagttaaattcaaacaatttaactcaactatggaaaaccaacctacagcttctaacccatcagatgcaccaccaactgctgctcaagctggtgcccagagcccagccgacttctcaaatcctaatacagctccttccctaagtgatttgaagaagatcaaatacgtgtcaactgtcacttcagttgccacgcctgctgaaattgaggcccttggcaagatctttactgccatgggtttagcagccaatgagaccggacctgccatgtgggacctcgctcgtgcttatgctgacgtgcaaagttcaaaatctgcacaacttataggtgccacaccatccaaccctgctttgtctagacgtgcacttgctgcacagtttgatcgtatcaatatcacacccagacaattctgcatgtattttgcaaaaattgtttggaacatactgttagacagcaatgtgccacctgccaactgggcaaaattgggctatcaggaagataccaagtttgctgctcttgacttctttgatggagtcacaaatccagctagtctacagcctgcagatggcctaatcaggcagcccaatgaaaaagagcttgccgctcactcggttgctaaatatggtgcccttgcccgccagaaaatatccactggcaactacatcaccacccttggtgaagttacacgtggtcacatgggcggcgccaacactatgtacgcaattgatgcacctcctgaactttaaacactcgaaacttaaccagagtggggttttctatagtttattttcccttagtatctaaatctactaaat

SEQ ID NO: 356 - DNA, 6449 bp, Pepino mosaic virus
  modified_base (1196)..(1196): a, c, g, t, unknown or other
gaaaacaaaataaataaataaatatacaaagttaaactaacacaacataaccacgtggaaaaacagcgaaagcactttaccacattatgtctcgtgtcagaaatactttggaaaagatcagagacccacgagtacagtccagcatttgtgaagctgcctatcaacatgttcgacctgtacttaaagaatctctaatcaattgtccttacgcgcttaatgattatgaagcagacacccttgagaatcttggtgtcacaattaacccccatgcaatccaaacacacacacatgccgcagccaaagtagtcgaaaatcgtatgcttgaaattgttggacatcacttgcctaaagatgaaaaagtaactttcatcttcctcaaacgtagcaagctgcgttacatgagaagagctgctgtgcataaagatgtctttgtcaatcataacattgaaccaaaagacttcttcaggtatgatgaagagtctacatcaaccagcttttccgttgatacgagaatcgcatacatttcagattctctacgctttatggaacctgctgatgtgactcacttgtttgaccgttgccaaaaccttaaaacattgatggcaactgttgtactacctgtggaagccatacacagacagacatctctattccctgcgatttactccattaactacaatgaagaaggcttcgagtatatcccaggatcacacggtggtggggcatatttccacaaatatgaaaccctagaatggctcaaatactctagattcattggacacgatccattgactggtttaaaatacgccattacgattcaaatggtggagagtcttggtgccaaccaccttttcctcttccaaagaggaaactttgagacgccgctatacaggacgtttcaaaagaatagttttgtgacattcccaaatatattccatccccgacacgtcaatgccacaaaacctatgcctagatcaagggccatacagctgtacttatatgtgaaatcagtaaataaagttacgcaaagagatatatttgccaaggttagacaactgatttccactgctgagctagaattgtatgaccctgatgaactcacgcatgttgtaaattatttcacatatgtgtcacaactgtcatctatcaatgattatgacaacatgctcaaatccagtttcttcaaaaaactggtngcacccatgcaacacgactggaggtgcatgattgaattcttccggggaaagagtgacttcaatcaactgctcacagctcttcaatggaaagatttttcctatactattaagactgaagagcttgtaattactacacacactgctataggacaagcaataagcaatgcagctgccacatataaagaaagaaagcagctgactcaattggttaaaaaagatataatatccttagcagattttgaacagagagaacctgaaataacttacactgagtttgagcctgaaactaggccccaagtggactgcgttactaattataataatgcagtaaaaaatttaggtctttctgcacttgatgaacagccccaatgttcatcttctaacagtcatctaccctgcaatgaaatatccttagcaatgactgatgacgacaatgctgcggccattcatgaaattgaatctctattgtctgaaccaataatagctcctcaactcccagcattgccacacaagacatgggccagttatgcttcagacacttcatccatgaagaaccgtgagattgagaacataattgctgagcttgaaatctcacggaaggaaaataatgtgcagcaaactactcatgattaccatgcagtttttgacacagctcagagctccggagatctcccatggaaagcatggattccacttctgaatgcacacggcttcaagggagaccaacttcaatacagtccggatggcaaagtgattcagccaatccaggacatcaacaacaaaacaccaaggtctgagtacccatccagcattcctgcagatcttgtgaatacactgcgcaacattaaaagagcagtgtatgccattcctattagccatcgaagggcaagtgcttacagctctgatatcaaaaacaataggaccggcaaattactctgttcccaatcaaaagaatggaaggaaagttttgctttcaaaatgcaacatgaagacatcgttaaatctggagtagtcattcatggctgtggcggctctggaaaatcacaagcattacaaaactttctcagaactcttggcgactctaatgactgctgcacagtggttgtgccaactgttgaactcagaaatgattgggtgaacaaattatgtaagctacccatggaacacattaaaacatttgaaaaagcaatgattcaaccaggattcccagttgttatctttgatgactacactaaattgccacctggttacattgaagcctatttgttccaccatgccaacactgaacttttcattcttactggagactcgcggcaaagtgtatatcatgagtccaacaatgaagcatacattgcctcattagatgaagccgtcgcttattatgctaactactgtggattttacctaaatgctacacacagaaatgttcgcagtttggccaataagctaggtgtttacagtgagaaagaaggtcacctcaaaattacctttgcctcaaatgctctacaaaagtgcaaagtgccaattttggtgccctctcaaatgaagaagagagctatgcaagacatagggcacaaagccatgacctacgctgggtgtcaagggcttactgcaccgagagtccaaattttgcttgacaaccacacacaacactgctcagacagggtgctgtacacttgtctctccagagctgtggattccatccactttatcaatacaggcccaaacaattctgaattttgggacaagcttgaggcaacaccatacctcaaagcatttattgatacttacagagatgagaaaacagaaatgctcaattctaagcctgctgatgacagtcccgctgagcctgaagctccattgacccactttccagtgtcaaacggcaataacttggaaaagttagcttcagcgcttcctgaaaaattcgcaagagagttatatgataaacaccatggatattctaatacaatccaaactgaaaatccagtggtgcaacttttccagcatcaacaagccaaagatgaaacacttttctgggcaacaatagaagctagactttctattacaactccggaagccaacttacgagaatttgtgctaaagaaagatgttggagatatcttgtttttcaattaccacaatgtcatgtgcttacctgccgacccagtggatttcgagccaagaacatgggaaatatgtgctgctgaagttaaaaatacatacttagccaaaccaatggctaacttgatcaatgctgctagcagacaatctcctgatttcgacgctaacaaaatttccctgttcctaaaatctcaatgggtcaagaaagtggaaaaattaggtgctgtcaagtcaaagcctggccagaccattgcggctttcatgcaacaaacagtgatgttgtatgggaccatggccagatacctcagaaagatgcgacaaagatttcaaccaaaacatatttttatcaattgtgaaacaacaactggtaatctgaaccaatttgttaaacaaggttggaactttaacagaacagctcagacaaatgatttcacagcttttgaccaatcacaagatggtgcaatgcttcaatttgaagtcatgaaggcaaaattcttcaatatccctgccgacatcattgaaggatacatcaacatcaaattgaacgccaaaattttccttggcacattgtccattatgaggttgtctggtgaaggtccaacttttgatgccaacacagaatgttcaatagcatatactgctacaagataccatcttgattctacagtcaagcaggtttatgctggagatgatatggcattagatggagttgtccaagaaaaaccctcttttaaaaaactacagaacaagcttaaactcacctcaaagacactatttccaaaacaggttaaaggtgattatgctgaattctgcggttggactttcactcctggtggtatcattaaaaaccctttgaaaatgcatgcttccattatgttgcaagaggcaatcggcaatttacacactgctgccagatcatatgccattgacatgaagcattcataccaaatgggtgatgagctgcacaattacttaacaccagatgaagctgaacaacacttccttgctgttcggaagttgcacaagttacaccaaggcgaagcaatgagacttggtgaaaagagccctccaaaagcaacacattgaggggttaagttttccccagttcgaaatggaaagatcaactctgattaatttacttcaattgcaccacttcgagccaaaactcagtgttgaaggaatcatagttgtgcacggaattgcaggcactgggaaaaccactttacttaggactttattttctgcttaccctagcttagttataggttcacctaggccttgctatttagataaacaaaacaaaatttcacaagtttgcttatcttgctttcccaatacccattgtgatattgtcgatgagtatcatttgctagaaagttttccagaaccaaaattggctatctttggtgacccctgtcaatgcacatacattgagagacttagagtcccacattacacttccttcagaactcatagatttggaaagtcaactgctgagattttgaacaaactgtttgaccttaatatagtctcagttaagaaagaagacgacatcgttgaattctttaacccttttgaagttgaccccactgagcatatctctgcctctgaagaagaagtcttggactttgtttctgaccaagtggtgaccactagctcagaggaactagcaggacttgagtttgcagaaacaactttctactgcaccacattggccgcagctgttgctgaaaatcctgctaagactttcatctctctgactagacacacccacaaactcaccattggggaactaaatgccaggtctaactcctagagctgacctcactgacacatacaaaatcattgccattgctttcttgttgtcagcttgcatttacttccaaaatagccactaccaacctgttgctggagacaacttgcaccgtttgccttttggtggccaatatcaagacggcaccaaaaagatatcttattttccacaacagcagtcatactttcattctggaaacaaattaaatgtcctcatgcttatcttcattctcacattgggtatcgtcctcaccaataaatttagttttagctttagtcgtactactcaccagcattcttgctataacacatatccagcaaccaacaatacacaaccattgtcaggtcatcattgacggtgctgcaatagtcataacaaattgtgagaacacaccagaagtgcttaaagcaatcaacttctccccttggaacgggttaagttttcctaaatttgaaaattaatattgagtgttcacaaaaatcaacttcaataaacaatcatgcctgacacaacacctgttgctgccacttcaagtgcaccacccacagccaaagatgctggtgccaaagctccttctgtcttctcaaatcccaatacagctcctagtttcagtgatttgaagaaagtcaagtatgtctccaccgtgacctccgtggccacaccagctgaaattgaagccctaggcaaaatcttcaccgctatgggccttgccgccaatgagactggtccggccatgtgggatctagctcgtgcgtatgctgatgtgcagagttctaaatcggcacagctgattggagctaccccttccaaccctgcactatcacgccgagcccttgctgctcagtttgatcgaatcaatataacccccaggcaattttgcatgtactttgccaaagttgtttggaacatacttctcgacagcaacattccaccagcaaattgggccaaacttggttaccaagaagatacaaaatttgctgcatttgacttcttcgatggagtcaccaaccctgccagcctgcagcctgctgatggtcttatcaggcagccaaatgagaaagaactagctgctcactccgtagctaagtacggcgccttggctaggcaaaagatctccacaggtaattatattaccacacttggagaagtcacacgtggacacatgggaggagctaacaccatgtacgcgatagacgcaccccctgaactttaaacactcgaaacttaatcagagtggggttttctacagtttattttcctaattatttctttgaaattaaaaaaaaaaaaaaaaaaaaaaaaaaaaaaaaaaaaaa

SEQ ID NO: 357 - DNA, 6449 bp, Pepino mosaic virus
gaaaacaaaataaataaacaattatacaaagttaaactaacacaacataaccacgtggaaaaacagcgaaagcactttaccgcattatgtctcgtgtcagaaatactttggaaaagatcagagacccacaagtacagtccagcatttgtgaagctgcctatcaacatgttcgacctgtacttaaagaatctctaatcaattgtccttacgcgcttaatgattatgaagcagacacccttgagaatcttggtgtcacaattaacccccatgcaatccaaacacacacacatgccgcagccaaagtagtcgaaaatcgtatgcttgaaattgttggacatcacttgcctaaagatgaaaaagtaactttcatcttcctcaaacgtagcaagctgcgttacatgagaagagctgctgtgcataaagatgtctttgtcaatcataacattgaaccaaaagacttcttcaggtatgatgaagagtccacatcaaccagcttttccgttgatacgagaatcgcatacatttcagattctctacactttatggaacctgctgatgtgactcacttgtttgaccgttgccaaaaccttaaaacattgatggcaactgttgtactacctgtggaagctatacacagacagacatctctattccctgcgatttactccattaactacaatgaagaaggctttgagtatatcccaggatcacacggtggtggggcatatttccacaaatatgaaactctagaatggctcaaatactctagattcattggacatgatccattgactggtttaaaatacaccattacgattcaaatggtggagagtcttggtgccaaccaccttttcctcttccaaagaggaaactttgagacgccgctatacaggacgtttcaaaagaatagttttgtgacattcccaaatatattccatccccgacacgtcaatgccacaaaacctatgcctagatcaagggccatacagctgtacttatatgtgaaatcagtaaataaagttacgcaaagagatatatttgccaaggttagacaactgatttccactgctgagctagaattgtatgaccctgatgaactcacgcatgttgtaaattatttcacatatgtgtcacaactgtcatctatcaatgattatgacaacatgctcaaatccagtttcttcaaaaaactggttgcacccatgcaacacgactggaggtgcatgattgaattcttccggggaaagagtgacttcaatcaactgctcacagctcttcaatggaaagatttttcctatactattaagactgaagagcttgtaattactacacacactgctataggacaagcaataagcaatgcagctaccacatataaagaaagaaagcagctgactcaattggtcaaaaaaggtacaatatccttagcagattttgaacagagagaacctgaaataacttacactgagtttgagcctgaaactaggccccaagtggactgcgttactaattataataatgcagttaaaaatttaggtctttctgcacttgatgaacagcctcaatgttcatcttctagcagtcatctaccctgcaatgaaatatccttagcaatgactgatgacgacaatgctgcggccattcatgaaattgaatctctattgtctgaaccgataatagctcctcaacttccagcattgccacacaagacatgggccagttatgcttcagacacttcatccatgaagaaccgtgagattgagaacataattgctgagcttgaaatctcacggaaggaaaataatgtgcagcaaactactcatgattaccatgcagtttctgacacagctcagagctccggagatctcccatggaaagcatggattccacttctgaatgcacacggcttcaagggagaccaacttcaatacagtccggatggcaaagtgattcagccaatccaggacatcaacaacaaaacaccaagatctgagtacccatccagcattcctgcagatcttgtgaatacactgcgaaacattaaaagagcagtgtatgccattcctattagccatcgaagggcaagtgcttacagctctgatatcaaaaacaataggaccggcaaattactctgttcccaatcaaaagaatggaaggaaagttttgctttcaaaatgcaacatgaagacatcgttaaatctggagtagtcattcacggctgtggcggctctggaaaatcacaagcattacaaaactttctcagaactcttggcgactctaatgactgctgcacagtggttgtgccaactgttgaactcagaaatgattgggtgaacaaattgtgtaagctacccatggaacacattaaaacatttgaaaaagctatgattcaaccaggattcccagttgttatatttgatgactacactaaattgccacctggttacattgaagcctatttgttccaccatgccaacactgaacttttcattcttactggagactcgcggcaaagtgtatatcatgagtccaacaatgaagcatacattgcctcattagatgaagccgtcgcttattatgctaactactgtggattttacctaaatgctacacacagaaatgttcgcagtttggccaataagctaggtgtttacagtgagaaagaaggtcacctcaaaattacctttgcctcaaatgctctacaaaagtgcaaagtgccaattttggtgccctctcaaatgaagaagagtgctatgcaagacatagggcacaaagccatgacctacgctgggtgtcaagggcttactgcaccgagagtccaaattttgcttgacaaccacacacaacactgctcagacagggtgctgtacacttgtctctccagagctgtggattccatccactttatcaatacaggcccaaacaattctgaattttgggacaagcttgaggcaacaccatacctcaaagcatttattgatacttacagagatgagaaaacagaaatgctcaattctaagcctgctgatgacagtcccgctgagcctgaagctccattgactcactttccagtgtcaaacggcaataacttggaaaagttagcttcagcgcttcctgaaaaatttgcaagagagttatatgataaacaccatggatattctaatacaatccaaactgaaaatccagtggtgcaacttttccagcatcaacaagccaaagatgaaacacttttctgggcaacaatagaagctagactttctattacaactccggaagccaacttacgagaatttgttctaaagaaagatgttggagatatcttgtttttcaattaccacaatgtcatgtgcttacctgccgacccagtggatttcgagccaagaacatgggaaatatgtgctgctgaagttaaaaatacatacttagccaaaccaatggctaacttgatcaatgctgctagcagacaatctcctgatttcgacgctaacaaaatttccctgttcctaaaatctcaatgggtcaagaaagtggaaaaattaggtgctgtcaagtcaaagcctggccaaaccattgcagctttcatgcaacaaacagtgatgttgtatgggaccatggccagatacctcagaaagatgagacaaagatttcaaccaaaacatattttcatcaattgtgaaacaacaactgataatctgaaccaatttgttaaacaaggttggaactttaacagaacagctcagacaaatgatttcacagcttttgaccaatcacaagatggtgcaatgcttcaatttgaagtcatgaaggcaaaattcttcaatatccctgccgacatcattgaaggatacatcaacatcaaattgaacgccaaaatttttcttggcacattgtccattatgaggttgtctggtgaaggtccaacttttgatgccaacacagaatgttcaatagcatataccgctacaagataccatcttgattctacagtcaagcaggtttatgctggagatgatatggcattagatggagttgtccaagaaaaaccctcttttaaaaaactacagaacaagcttaaactcacctcaaagacactatttccaaaacaggttaaaggtgattatgctgaattctgtggttggactttcactcctggtggtatcattaaaaaccctttgaaaatgcatgcttccattatgttgcaagaggcaatcggcaatttacacactgctgccagatcatatgccattgacatgaagcattcataccaaatgggtgatgagctgcacaattacttaacaccagatgaagctgaacaacacttccttgctgttcggaagttgcacaagttacaccaaggagaagcaatgagacttggtgaaaagagccctccaaaagcaacacattgaggggttaagttttccccagttcgaaatggaaagatcaactctgattaatttacttcaattgcaccacttcgagccaaaactcagtgttgaaggaatcatagttgtgcacggaattgcaggcactgggaaaaccactttacttaggactttattttctgcttaccctagcttagttataggttcacctaggccttgctatttagataaacaaaacaaaatttcacaagtttgcttatcttgctttcccaatacccattgtgatattgtcgatgagtatcatttgctagaaagttttctagaaccaaaattggctatctttggtgacccctgtcaatgcacatacattgagagacttagagtcccacattacacttccttcagaactcatagatttggaaagtcaactgctgagattttgaacaaactgtttgacctcaatatagtctcagtcaagaaagaagacgacatcgttgaattctttaacccttttgaagttgaccccactgagcatatctctgcctctgaagaagaagtcttgggctttgtttctgaccaagtggtgaccactagctcagaggaactagcaggacttgagtttgcagaaacaactttctactgcacaacattggccgcagctgttgctaaaaatcctgctaagactttcatctctctgactagacacacccacaaactcaccattggggaactaaatgccaggtctaactcctagagctgacctcactgacacatacaaaatcattgccattgctttcttgttgtcagcttgcatttacttccaaaatagccactaccaacctgttgctggagacaacttgcaccgtttgccttttggtggccaatatcaagacggcaccaaaaagatatcttattttccacaacagcagtcatactttcactctggaaacaaattaaatgtcctcatacttatcttcattctcacattgggtattgtcctcaccaataaatttagttttagctttagtcgtactactcaccagcattcttgctataacacacattcagcaaccaacaatacacaaccattgtcaggtcatcattgacggtgctgcaatagtcataacaaattgtgagaacacaccagaagtgcttaaagcaatcaacttctccccttggaacgggttaagttttcctaaatttgaaaattaatattgagtgttcacaaaatcaacttcaataaacaatcatgcctgacacaacacctgttgctgccacttcaagtgcaccacccacagccaaagatgctggtgccaaagctccttctgacttctcaaatcccaatacagctcctagtctcagtgatttgaagaaagtcaagtatgtctccaccgtgacctccgtggccacaccagctgaaattgaagccctaggcaaaatcttcaccgctatgggccttgccgccaatgagactggtccggccatgtgggatctagctcgtgcatatgctgatgtgcagagttctaaatcggcacagctgattggagctaccccttccaaccctgcactatcacgccgagcccttgctgctcagtttgatcgaatcaatataacccccaggcaattttgcatgtactttgccaaagttgtttggaacatacttctcgacagcaacattccaccagcaaattgggccaaacttggctaccaagaagatacaaaatttgctgcatttgacttcttcgatggagtcaccaaccctgccagcctgcagcctgctgatggtcttatcaggcagccaaatgagaaagaactagctgctcactccgtagctaagtacggcgccttggctaggcaaaagatctccacaggtaattatattaccacacttggagaagtcacacgtggacacatgggaggagctaacaccatgtacgcgatagacgcgccccctgaactttaaacactcgaaacttaatcagagtggggttttctacagtttattttcctaattatttctttgaaacaaaaaaaaaaaaaaaaaaaaaaaaaaaaaaaaaaaaaaaa

SEQ ID NO: 358 - DNA, 6449 bp, Pepino mosaic virus
gaaaacaaaataaataaataaatatacaaagttaaactaacacaacataaccacgtggaaaaacagcgaaagcactttaccacattatgtctcgtgtcagaaatactttggaaaagatcagagacccacaagtacagtccagcatttgtgaagctgcttatcaacatgttcgacctgtacttaaagaatctctaatcaattgtccttacgcgcttaacgattatgaagcagacacccttgagaatcttggtgtcacaattaacccccatgcaatccaaacacacacacatgccgcagccaaagtagtcgaaaatcgtatgcttgaaattgttggacatcacttgcctaaagatgaaaaagtaactttcatcttcctcaaacgtagcaagctgcgttacatgagaagagctgctgtgcataaagatgtctttgtcaatcataacattgaaccaaaagacttcttcaggtatgatgaagagtccacatcaaccagcttttccgttgatacgagaatcgcatacatttcagattctctacactttatggaacctgctgatgtgactcacttgtttgaccgttgccaaaaccttaaaacattgatggcaactgttgtactacctgtggaagctatacacagacagacatctctattccctgcgatttactccattaactacaatgaagaaggctttgagtatatcccaggatcacacggtggtggggcatatttccacaaatatgaaactctagaatggctcaaatactctagattcattggacatgatccattgactggtttaaaatacaccattacgattcaaatggtggagagtcttggtgccaaccaccttttcctcttccaaagaggaaactttgagacgccgctatacaggacgtttcaaaagaatagttttgtgacattcccaaatatattccatccccgacacgtcaatgccacaaaacctatgcctagatcaagggccatacagctgtacttatatgtgaaatcagtaaataaagttacgcaaagagatatatttgccaaggttagacaactgatttccactgctgagctagaattgtatgaccctgatgaactcacgcatgttgtaaattatttcacatatgtgtcacaactgtcatctatcaatgattatgacaacatgctcaaatccagtttcttcaaaaaactggttgcacccatgcaacacgactggaggtgcatgattggattcttccggggaaagagtgacttcaatcaactgctcacagctcttcaatggaaagatttttcctatactattaagactgaagagcttgtaattactacacacactgctataggacaagcaataagcaatgcagctaccacatataaagaaagaaagcagctgactcaattggtcaaaaaaggtacaatatccttagcagattttgaacagagagaacctgaaataacttacactgagtttgagcctgaaactaggccccaagtggactgcgttactaattataataatgcagttaaaaatttaggtctttctgcacttgatgaacagcctcaatgttcatcttctagcagtcatctaccctgcaatgaaatatccttagcaatgactgatgacgacaatgctgcggccattcatgaaattgaatctctattgtctgaaccgataatagctcctcaacttccagcattgccacacaagacatgggccagttatgcttcagacacttcatccatgaagaaccgtgagattgagaacataattgctgagcttgaaatctcacggaaggaaaataatgtgcagcaaactactcatgattaccatgcagtttctgacacagctcagagctccggagatctcccatggaaagcatggattccacttctgaatgcacacggcttcaagggagaccaacttcaatacagtccggacggcaaagcgattcagccaatccaggacatcaacaacaaaacaccaagatctgagtacccatccagcattcctgcagatcttgtgaatacactgcgaaacattaaaagagcagtgtatgccattcctattagccatcgaagggcaagtgcttacagctctgatatcaaaaacaataggaccggcaaattactctgttcccaatcaaaagaatggagggaaagttttgctttcaaaatgcaacatgaagacatcgttaaatctggagtagtcattcacggctgtggcggctctggaaaatcacaagcattacaaaactttcccagaactcttggcgactctaatgactgctgcacagtggttgtgccaactgttgaactcagaaatgattgggtgaacaaattgtgtaagctacccatggaacacattaaaacatttgaaaaagcaatgattcaaccaggattcccagttgttatatttgatgactacactaaattgccacctggttacattgaagcctatttgttccaccatgccaacactgaacttttcattcttactggagactcgcggcaaagtgtatatcatgagtccaacaatgaagcatacattgcctcattagatgaagccgtcgcttattatgctaactactgtggattttacctaaatgctacacacagaaatgttcgcagtttggccaataagctaggtgtttacagtgagaaagaaggtcacctcaaaattacctttgcctcaaatgctctacaaaagtgcaaagtgccaattttggtgccctctcaaatgaagaagagtgctatgcaagacatagggcacaaagccatgacctacgctgggtgtcaagggcttactgcaccgagagtccaaattttgcttgacaaccacacacaacactgctcagacagggtgctgtacacttgtctctccagagctgtggattccatccactttatcaatacaggcccaaacaattctgaattttgggacaagcttgaggcaacaccatacctcaaagcatttattgatacttacagagatgagaaaacagaaatgctcaattctaagcctgctgatgacagtcccgctgagcctgaagctccattgactcactttccagtgtcaaacggcaataacttggaaaagttagcttcagcgcttcctgaaaaatttgcaagagagttatatgataaacaccatggatattctaatacaatccaaactgaaaatccagtggtgcaacttttccagcatcaacaagccaaagatgaaacacttttctgggcaacaatagaagctagactttctattacaactccggaagccaacttacgagaatttgtgctaaagaaagatgttggagatatcttgtttttcaattaccacaatgtcatgtgcttacctgccgacccagtggatttcgagccaagaacatgggaaatatgtgctgctgaagttaaaaatacatacttagccaaaccaatggctaacttgatcaatgctgccagcagacaatctcctgatttcgacgctaacaaaatttccctgttcctaaaatctcaatgggtcaagaaagtggaaaaattaggtgctgtcaagtcaaagcctggccagaccattgcagctttcatgcaacaaacagtgatgttgtatgggaccatggccagatacctcagaaagatgagacaaagatttcaaccaaaacatattttcatcaattgtgaaacaacaactgataatctgaaccaatttgttaaacaaggttggaactttaacagaacagctcagacaaatgatttcacagcttttgaccaatcacaagatggtgcaatgcttcaatttgaagtcatgaaggcaaaattcttcaatatccctgccgacatcattgaaggatacatcaacatcaaattgaacgccaaaatttttcttggcacattgtccattatgaggttgtctggtgaaggtccaacttttgatgccaacacagaatgttcgatagcatatactgctacaagataccatcttgattctacagtcaaacaggtttatgctggagatgatatggcattagatggagttgtccaagaaaaaccctcttttaaaaaactacagaaccagcttaaactcacctcaaagacactatttccaaaacaggttaaaggtgattatgctgaattctgtggttggactttcactcctggtggtatcattaaaaaccctttgaaaatgcatgcttccattatgttgcaagaggcaatcggcaatttacacaccgctgccagatcatatgccattgacatgaagcattcataccaaatgggtgatgagctgcacaattacttaacaccagatgaagctgaacaacacttccttgctgttcggaagttgcacaagttacaccaaggagaagcaatgagacttggtgaaaatagccctccaaaagcaacacattgaggggttaagttttccccagttcgaaatggaaagatcaactctgattaatttacttcaattgcaccacttcgagccaaaactcagtgttgaaggaatcatagttgtgcacggaattgcaggcactgggaaaaccactttacttaggactttattttctgcttaccctagcttagttataggttcacctaggccttgctatttagataaacaaaacaaaatttcacaagtttgcttatcttgctttcccaatacccattgtgatattgtcgatgagtatcatttgctagaaagttttccagaaccaaaattggctatctttggtgacccctgtcaatgcacatacattgagagacttagagtcccacattacacttccttcagaactcatagatttggaaagtcaactgctgagattttgaacaaactgtttgaccttaatatagtctcagttaagaaagaagacgacatcattgaattctttaacccttttgaagttgaccccactgagcatatctctgcctctgaagaagaagtcttggactttgtttctgaccaagtggtgaccactagctcagaggaactagcaggacttgagtttgcagaaacaactttctactgcacaacattggccgcagctgttgctgaaaatcctgctaagactttcatctctctgactagacacaccaacaaactcaccattggggaactaaatgccaggtctaactcctagagctgacctcactgacacatacaaaatcattgccattgctttcttgttgtcagcttgcatttacttccaaaatagccactaccaacctgttgctggagacaacttgcaccgtttgccttttggtggacaatatcaagacggcaccaaaaagatatcttattttccacaacagcagtcatactttcattctggaaacaaattaaatgtcctcatacttatcttcattctcacattgggtattgtcctcaccaataaatttagttttagctttagtcgtactactcaccagcattcttgctataacacacattcagcaaccaacaatacacaaccattgtcaggtcaccattgacggtgctgcaatagtcataacaaattgtgagaacacaccagaagtgcttaaagcaatcaacttctccccttggaacgggttaagttttcctaaatttgaaaattaatattgagtgttcacaaaaatcaacttcaataaacaatcatgcctgacacaacacctgttgctgccacttcaagtgcaccacccacagccaaagatgctggtgctaaagctccttctgacttctcaaatcccaatacagctcctagtctcagtgatttgaagaaagtcaagtatgtctccaccgtgacctccgtggccacaccagctgaaattgaagccctaggcaaaatcttcaccgctatgggccttgccgccaacgagactggtccggccatgtgggatctagctcgtgcatatgctgatgtgcagagttctaaatcggcacagctgattggagctaccccttccaaccctgcactatcacgccgagcccttgctgctcagtttgatcgaatcaatataacccccaggcaattttgcatgtactttgccaaagttgtttggaacatacttctcgacagcaacattccaccagcaaattgggccaaacttggttaccaagaagatacaaaatttgctgcatttgacttcttcgatggagtcaccaaccctgccagcctgcagcctgctgatggtcttatcaggcagccaaatgagaaagaactagctgctcactccgtagctaagtacggcgccttggctaggcaaaagatctccacaggtaattatattaccacacttggagaagtcacacgtggacacatgggaggagctaacaccatgtacgcgatagacgcaccccctgaactttaaacactcgaaacttaatcagagtggggttttctacagtttattttcctaattatttctttgaaataaaaaaaaaaaaaaaaaaaaaaaaaaaaaaaaaaaaaaa

SEQ ID NO: 359 - DNA, 6448 bp, Pepino mosaic virus
gaaaacaaaatataaacaaatatacaaagttaaactaacacaacataaccacgtggaaaaacagcgaaagcactttaccacattatgtctcgtgtcaggaatactttggaaaagatcagagacccacaagtacagtccagcatttgcgaagccgcatatcaacatgttcgacccgtacttaaagaatctctaatcaattgtccttatgcgcttaatgattatgaagcagacacccttgagaatcttggtgtcacaattaatccccacgcaatccaaacacacacacatgccgcagctaaagtagttgaaaatcgtatgcttgaaatcgttggacatcacttgccaaaagatgaaaaggtaacttttatcttcctcaaacgtagcaagctgcgttacatgagaagagctgctgtgcataaagatgtctttgtcaatcataacattgaaccaaaagacttcttcaggtatgatgaagagtctacatcaactagcttttccgttaatacgagaatcgcatacatttcagattctctacactttatggaacctgctgatgtgactcacttgtttgaccgttgccaaaaccttaaaacattaatggcaactgttgtactacctgttgaagctatacacagacagacatccctattccctgccatttactccattaactacaatgaagaaggctttgagtacatcccaggatcacacggtggtggggcatatttccacaaatatgaaaccctagaatggctcaaatactctagattcattggacatgatccattgactggtttaaaatacaccattacaattcaaatggtagagagtcttggtgccaaccaccttttccttttccaaagaggaaactttgagacgccgttataccggacgtttcaaaagaatagttttgtgacattcccaaatatatttcatccccgacatgtcaatgccacaaaacctatgcctagatcaagggccatacagctgtacctatatgtgaaatcagtaaataaagttacgcaaagagacatatttgctaaacttagacaactgatttccactgctgaactagaattgtatgaccctgatgaactcacgcatgttgtaaattatttcacatatgtgtcacaactgtcatctatcaatgattatgacaacatgctcaaatccagtttctttaaaaaactggtggcacccatgcaacacgactggaggtgcatgattgaattcttccggggaaagagtgacttcaatcaactgctaacagctcttcaatggaaagatttttcatacactattaagactgatgagcttgtaatcactacacacactgctataggacaagcaatatgcaatgcagctgctacatataaagaaagaaggcagctgactcaattggtcaaaaatggtacaatatccttagcagattttgaacagaaagaacctgaaataacctacactgaatttgagcctgaaactaggccccaggtggactgcgttactaattacaataatgcagtcagaaatttaggtctttctgcactcgatgaacagcctcaatgttcatcttctaacagtcatataccctgcaatgaaatatctctagcaatgactgatgatgataatgctgcggccattcatgaaattgaatctctattgtctgaaccgataatagctcctcaactcccagcattgccacacaagacatgggctagttatgcttccgacacatcatctatgaagaaccgtgaaattgagaacataattgctgagcttgaaatctcacggaaggaaaacaatgtgcagcaaactactcatgattaccatgctgtttctgatactgctcaaaactctggaggtctcccatggaaagcatggattccacttctgaatgcacacggctttaagggagaccaacttcaatacagtcctgatggcaaagtgattcagccaattcaggacatcaataacaaaacaccaagatctgagtacccatccagtattcctgcagatcttgtaactacactgcgaaacattaaaagagcagtgtatgccattcctattagccatcgaagggcaagtgcttacagctctgatatcaagaacaataggactggcaaattgctttgctcccaatcaaaagaatggaaggaaagttttgctttcaaaatgcgacatgaagacatcgttaaatctggagtggtcattcatggctgtggtggctctggaaaatcacaagcattacaaaactttctcagaactcttggcgacaccaacgactgttgcacagtggtggtgccaactgttgagctcagaaatgattgggtgaacaaattgtgcaaactacccatggaacacattaaaacatttgaaaaagcaatgattcaaccaggattcccagtcgttatctttgatgactacaccaaattgccacctggttacattgaagcctatttgttccaccatgccaacaccgaacttttcattctcactggagactcgcggcaaagtgtatatcatgagtccaacaatgaagcatacattgcctccttagatgaagccgttgcttactatgctaactactgcggattttacctaaatgctacacatagaaatgttcgcagtttagccaataagctaggtgtttacagtgagaaagaaggccacctcaaaattacctttgcctcaaatgctctacaaaagtgcaaagtgccaattttagtgccttctaaaatgaagaaaggtgccatgcaagacatagggcacaaagccatgacctacgctggttgtcaagggcttactgctccaagagtccaaattttgcttgacaaccacacacaacactgctcagacagggtgctgtacacatgtctctctagagctgttgattccatccattttatcaatacaggtccaaacaattctgaattttgggacaagctcgaggcaacaccatacctcaaagcatttattgatacttacagagatgagaaaacagaaatgctcaattctaaacctgctgacgacagtcctactgagcctgaagctccattgactcactttccagtgtccaacggcaacaacttggaaaagttagcttcagcacttcctgaaaaatttgcaagggagttgtatgacaaacaccatgggtattctaacacaatccaaactgaaaatccagtggtacaacttttccagcatcaacaagccaaagatgaaacgcttttctgggcaacaatagaagctagactttctattacaactccggaagccaatttacgagaatttgtgctgaagaaagatgttggagacatcttgtttttcaactaccacaatgcgatgtgcttacccgctgatccagtggactttgagccaagaacatgggaaatatgtgctgctgaagttaaaaatacttacttagccaaaccaatggctaacctgatcaatgctgctagcagacaatctcctgattttgatactaataaaatttccctgttcttaaaatctcaatgggtcaaaaaagtggaaaaattaggtgctgtcaaatcaaagcctggccagaccatcgcagctttcatgcaacaaacagtgatgttgtatgggaccatggccagatacctcagaaagatgagacaaagattccaaccaaagcatattttcattaattgtgagacaacaacggatgatctgaaccaatttgttaaacaaggttggaactttaacagaactgctcagacaaatgatttcacagcttttgaccaatcacaagatggtgcaatgcttcaatttgaagtcatgaaggcaaaattcttcaatatccctgctgacattattgaaggatacatcaatatcaaattgaacgccaaaattttccttggtacattgtccattatgaggttgtctggtgaaggtccaacttttgatgctaacacagaatgttcaatagcatatactgctacaagataccatctcgattccacagtcaagcaggtttatgctggagatgacatggcattagatggagttgtccaagaaaaaccctctttcaaaaatttacagaacaagcttaaactcacctcaaagacactatttccaaagcaggtcaaaggtgattacgctgaattctgtggttggactttcactcctggtggcatcattaaaaaccctttgaaaatgcatgcttcaatcatgttgcaagaggcaattggcaatttgcacactgctgccagatcatatgccattgacatgaagcattcataccaaatgggtgatgagctgcatgattacttaacaccagatgaagctgaacaacatttccttgctgttcggaaattgcacaagctacaccaaggagaagcaatgagacttggtgaaaagagccctccaaaatcaacacattgaggggttaagtttttcccagtttgaaatggaaagatcaactctgattaatttacttcaattgcaccacttcgagccaaaactcagtgttgaaggaatcatagttgtgcacggaattgcaggaactgggaaaaccactttacttaggactttattttctgcttaccctagcttagttataggttcacctaggccttgttatttagacaaacaaaataaaatttcacaagtttgcttatcttgctttcccaatacccattgtgacattgttgatgagtatcatttgctagaaagtttcccagaaccaaaattggctatctttggtgacccctgtcaatgcacatacgttgaaagacttagagtcccacattacacttccttcagaactcatagatttggaaagtcaactgctgagattttgaacaaactgtttgatcttaatataatctcagttaagaaagaagacgacattgttgaattctttaaccctttcgaagttgaccccactgaacatatctcagcctctgaagaagaagtcttagactttgtttctgaccaagtggtgaccaccagctcagaagaactagcaggacttgaatttgctgaaacaactttctactgcaccacactggcagcagccgttgctgaaaatcctgctaagactttcatctctctgaccagacacactcacaaactcaccattggggaactaaatgccaggtctaactcctagagctgacctcactgacacatacaaaatcattgccattgccttcttgttgtcagcctgcatttacttccaaaatagccactaccaacctgttgctggagacaatttgcaccgtttgccttttggtggccaatatcaagacggcactaaaaggatttcttattttccacaacagcagtcatactttcattctggaaacaaattaaatgtcctcatacttatcttcattctcacattgggtattgtcctcaccaataaatttagttttagctttagtcgtactactcaccagcattcttgctataacacacattcagcaaccaacaacacacaaccattgtcaggtcatcattgacggtgctgcaatagtcataacaaattgtgagaacacaccagaagtacttaaggcaatcaacttctccccctggaacgggttaagttttcctaagtttgaaaatcaatattgagtgttcacaacaatcaacttcaacaaacaatcatgcctgacacaacacctgttgctgccacttcaagtgcaccacctacagccaaagatgctggtgccaaagctccttctgacttctcaaatcccaatacagctcctagtctcagtgatttgaagaaagtcaagtatgtctccacagtgacttccgtggccacaccagctgaaattgaagccctaggcaaaatcttcaccgctatgggccttgccgccaatgagactggtccggcgatgtgggatctagctcgtgcgtatgctgatgtgcagagctctaaatccgcacagctgattggtgctaccccttccaaccctgcattatcacgccgagcccttgctgctcagtttgatcgaatcaatataacacccaggcaattttgcatgtactttgctaaagttgtttggaacatccttctcgacagcaatattccaccagcaaattgggctaaacttggttaccaagaagatacaaaatttgctgcatttgacttcttcgatggagtcaccaaccctgccagcctgcagcctgctgatggtctcatcaggcaaccaaatgagaaagaactagctgctcactcagtagctaaatatggcgccttggctaggcaaaagatctccacaggtaattatattaccacacttggagaagtcacacgtggacacatgggtggagctaacaccatgtacgcgatcgacgcaccccctgaactttaaacactcgaaacttaatcagagtggggttttctacagtttattttcctaattatttctttgaaacaaaaaaaaaaaaaaaaaaaaaaaaaaaaaaaaaaaaaaaa

SEQ ID NO: 360 - DNA, 6450 bp, Pepino mosaic virus
gaaaacaaaataaataaataaatatacaaagttaaactaacacaacataaccacgtggaaaaacagcgaaagcactttaccacattatgtctcgtgttagaaatactttggaaaagatcagagacccacaagtacagtccagcatttgtgaagctgcctatcaacatgttcgacctgtacttaaagaatctctaatcaattgtccttacgcgcttaatgattatgaagcagacacccttgagaatcttggtgtcacaattaacccccatgcaatccaaacacacacacatgccgcagccaaagtagtcgaaaatcgtatgcttgaaattgttggacatcacttgcctaaagatgaaaaagtaactttcatcttcctcaaacgtagcaagctgcgttacatgagaagagctgctgtgcataaagatgtctttgtcaatcataacattgaaccaaaagacttcttcaggtatgatgaagagtctacatcaaccagcttttccgttgatacgagaatcgcatacatttcagattctctacactttatggaacctgctgatgtgactcacttgtttgaccgttgccaaaaccttaaaacattgatggcaactgttgtactacctgtggaagctatacacagacagacatctctattccctgcgatttactccattaactacaatgaagaaggctttgagtatatcccaggatcacacggtggtggggcatatttccacaaatatgaaaccctagaatggctcaaatactctagattcattggacatgatccattgactggtttaaaatacaccattacgattcaaatggtggagagtcttggtgccaaccaccttttcctcttccaaagaggaaactttgagacgccgctatacaggacgtttcaaaagaatagttttgtgacattcccaaatatattccatccccgacacgtcaatgccacaaaacctatgcctagatcaagggccatacagctgtacttatatgtgaaatcagtaaataaagttacgcaaagagatatatttgccaaggttagacaactgatttccactgctgagctagaattgtatgaccctgatgaactcacgcacgttgtaaattatttcacatatgtgtcacaactgtcatctatcaatgattatgacaacatgctcaaatccagtttcttcaaaaaactggttgcacccatgcaacacgactggaggtgcatgattgaattcttccggggaaagagtgacttcaatcaactgctcacagctcttcaatggaaagatttttcctatactattaagactgaagagcttgtaattactacacacactgctataggacaagcaataagcaatgcagctaccacatataaagaaagaaggcagctgactcaattggtcaaaaaaggtacaatatccttagcagattttgaacagagagaacctgaaataacttacactgagtttgagcctgaaactaggccccaagtggactgcgttactaattataataatgcagtaaaaaatttaggtctttctgcacttgatgaacagcctcaatgttcatcttctagcagtcatataccctgcaatgaaatatccttagcaatgactgatgacgacaatgctgcggccattcatgaaattgaatctctattgtctgaaccgataatagctcctcaactcccagcattgccacacaagacatgggccagttatgcttcagacacttcatccatgaagaaccgtgagattgagaacataattgctgagcttgaaatctcacggaaggaaaataatgtgcagcaaactactcatgattaccatgcagtttttgacacagctcagagctccggagatctcccatggaaagcatggattccacttctgaatgcacacggcttcaagggagaccaacttcaatacagtccggatggcaaagtgattcagccaatccaggacatcaataacaaaacaccaagatctgagtacccatccagcattcctgcagatcttgtgaatacactgcgaaacattaaaagagcagtgtatgccattcctattagccatcgaagggcaagtgcttacagctctgatatcaaaaacaataggaccggcaaattactctgttcccaatcaaaagaatggagggaaagttttgctttcaaaatgcaacatgaagacatcgttaaatctggagtagtcattcatggctgtggcggctctggaaaatcacaagcattacaaaactttctcagaactcttggcgactctaatgactgctgcacagtggttgtgccaactgttgaactcagaaatgattgggtgaacaaattgtgtaagctacccatggaacacattaaaacatttgaaaaagcaatgattcaaccaggattcccagttgttatctttgatgactacactaaattgccacctggttacattgaagcctatttgttccaccatgccaacactgaacttttcattcttactggagactcgcggcaaagtgtatatcatgagtccaacaatgaagcatacattgcctcattagatgaagccgtcgcttattatgctaactactgtggattttacctaaatgctacacacagaaatgttcgcagtttggccaataagctaggtgtttacagtgagaaagaaggtcacctcaaaattacctttgcctcaaatgctctacaaaagtgcaaagtgccaattttggtgccctctcaaatgaagaagagtgctatgcaagacatagggcacaaagccatgacctacgctgggtgtcaagggcttactgcaccgagagtccaaattttgcttgacaaccacacacaacactgctcagacagggtgctgtacacttgtctctccagagctgtggattccatccactttatcaatacaggcccaaacaattctgaattttgggacaagcttgaggcaacaccatacctcaaagcatttattgatacttacagagatgagaaaacagaaatgctcaattctaagcctgctgatgacagtcccgctgagcctgaagctccattgactcactttccagtgtcaaacggcaataacttggaaaagttagcttcagcgcttcctgaaaaatttgcaagagagttatatgataaacaccatggatattctaatacaatccaaactgaaaatccagtggtgcaacttttccagcatcaacaagccaaagatgaaacacttttctgggcaacaatagaagctagactttctattacaactccggaagccaacttacgagaatttgtgctaaagaaagatgttggagatatcttgtttttcaattaccacaatgtcatgtgcttacctgccgacccagtggatttcgagccaagaacatgggaaatatgtgctgctgaagttaaaaatacatacttagccaaaccaatggctaacttgatcaatgctgctagcagacaatctcctgatttcgacgctaacaaaatttccctgttcctaaaatctcaatgggtcaagaaagtggaaaaattaggtgctgtcaagtcaaagcctggccagaccattgcagctttcatgcaacaaacagtgatgttgtatgggaccatggccagatacctcagaaagatgagacaaagatttcaaccaaaacatattttcatcaattgtgaaacaacaactgataatctgaaccaatttgttaaacaaggttggaactttaacagaacagctcagacaaatgatttcacagcttttgaccaatcacaagatggtgcaatgcttcaatttgaagtcatgaaggcaaaattcttcaatatccctgccgacatcattgaaggatacatcaacatcaaattgaacgccaaaatttttcttggcacattgtccattatgaggttgtctggtgaaggtccaacttttgatgccaacacagaatgttcaatagcatatactgctacaagataccatcttgattctacagtcaagcaggtttatgctggagatgatatggcattagatggagttgtccaagaaaaaccctcttttaaaaaactacagaacaagcttaaactcacctcaaagacactatttccaaaacaggttaaaggtgattatgctgaattctgtggttggactttcactcctggtggtatcattaaaaaccctttgaaaatgcatgcttccattatgttgcaagaggcaatcggcaatttacacactgctgccagatcatatgccattgacatgaaacattcataccaaatgggtgatgagctgcacaattacttaacaccagatgaagctgaacaacacttccttgctgttcggaagttgcacaagttacaccaaggagaagcaatgagacttggtgaaaagagccctccaaaagcaacacattgaggggttaagttttccccagttcgaaatggaaagatcaactctgattaatttacttcaattgcaccacttcgagccaaaactcagtgttgaaggaaccatagttgtgcacggaattgcaggcactgggaaaaccactttacttaggactttattttctgcttaccctagcttagttataggttcacctaggccttgctatttagataaacaaaacaaaatttcacaagtttgcttatcttgctttcccaatacccattgtgatattgtcgatgagtatcatttgctagaaagttttctagaaccaaaattggctatctttggtgacccctgtcaatgcacatacattgagagacttagagtcccacattacacttccttcagaactcatagatttggaaagtcaactgctgagattttgaacaaactgtttgaccttaatatagtctcagttaagaaagaagacgacatcgttgaattctttaacccttttgaagttgaccccactgagcatatctctgcctctgaagaagaagtcttggactttgtttctgaccaagtggtgaccactagctcagaggaactagcaggacttgagtttgcagaaacaactttctactgcacaacattggccgcagctgttgctgaaaatcctgctaagactttcatctctctgactagacacacccacaaactcaccattggggaactaaatgccaggtctaactcctagagctgacctcactgacacatacaaaatcattgccattgctttcttgttgtcagcttgcatttacttccaaaatagccactaccaacctgttgctggagacaacttgcaccgtttgccttttggtggccaatatcaagacggcaccaaaaagatatcctattttccacaacagcagtcatactttcattctggaaacaaattaaatgtcctcatacttatcttcattctcacgttgggtattgtcctcaccaataaatttagttttagctttagtcgtactactcaccagcattcttgctataacacacattcagcaaccaacaatacacaaccattgtcaggccatcattgacagtgctgcaatagtcataacaaattgtgagaacacaccagaagtgcttaaagcaataaacttctccccttggaacgggttaagttttcctaaatttgaaaattagtattgagtgttcacaaaaatcaacttcaataaacaatcatgcctgacacaacacctgttgctgccacttcaagtgcaccacccacagccaaagatgctggtgccaaagctccttctgacttctcaaatcccaatacagctcctagtctcagtgatttgaagaaagtcaagtatgtctccaccgtgacctccgtggccacaccagctgaaattgaagccctaggcaaaatcttcaccgctatgggccttgccgccaatgagactggtccggccatgtgggatctagctcgtgcatatgctgatgtgcagagttctaaatcggcacagctgattggagctaccccttccaaccctgcactatcacgccgagcccttgctgctcagtttgatcgaatcaatataacccccaggcaattttgcatgtactttgccaaagttgtttggaacatacttctcgacagcaacattccaccagcaaattgggccaaacttggttaccaagaagatacaaaatttgctgcatttgacttcttcgatggagtcaccaaccctgccagcctgcagcctgctgatggtcttatcaggcagccaaatgaaaaagaactagctgctcactccgtagctaagtacggcgccttggctaggcaaaagatctccacaggtaattatattaccacacttggagaagtcacacgtggacacatgggaggagctaacaccatgtacgcgatagacgcaccccctgaactttaaacactcgaaacttaatcagagtggggttttctacagtttattttcctaattatttctttgaaataaaaaaaaaaaaaaaaaaaaaaaaaaaaaaaaaaaaaaaa

SEQ ID NO: 361 - DNA, 6468 bp, Pepino mosaic virus
gaaaacaaaatataaacaaatatacaaagttaaactaacacaacataaccacgtggaaaaacagcgaaagcactttaccacattatgtctcgtgtcaggaatactttggaaaagatcagagacccacaagtacagtccagcatttgcgaagccgcatatcaacatgttcgacccgtacttaaagaatctctaatcaattgtccttatgcgcttaatgattatgaagcagacacccttgagaatcttggtgtcacaattaatccccacgcaatccaaacacacacacatgccgcagctaaagtagttgaaaatcgtatgcttgaaatcgttggacatcacttgccaaaagatgaaaaggtaacttttatcttcctcaaacgtagcaagctgcgttacatgagaagagctgctgtgcataaagatgtctttgtcaatcataacattgaaccaaaagacttcttcaggtatgatgaagagtctacatcaactagcttttccgttaatacgagaatcgcatacatttcagattctctacactttatggaacctgctgatgtgacccacttgtttgaccgttgccaaaaccttaaaacattaatggcaactgttgtactacctgttgaagctatacacagacagacatccctattccctgctatttactccattaactacaatgaagaaggctttgagtacatcccaggatcacacggtggtggggcatatttccacaaatatgaaaccctagaatggctcaaatactctagattcattggacatgatccattgactggtttaaaatacaccattacaattcaaatggtagagagtcttggtgccaaccaccttttccttttccaaagaggaaactttgagacgccgttataccggacgtttcaaaagaatagttttgtgacattcccaaatatatttcatccccgacatgtcaatgccacaaaacctatgcctagatcaagggccatacagctgtacctatatgtgaaatcagtaaataaagttacgcaaagagacatatttgctaaagttagacaactgatttccactgctgaactagaattgtatgaccctgatgaactcacgcatgttgtaaattatttcacatatgtgtcacaactgtcatctatcaatgattatgacaacatgctcaaatccagtttctttaaaaaactggtggcacccatgcaacacgactggaggtgcatgattgaattcttccggggaaagagtgacttcaatcaactgctaacagctcttcaatggaaagatttttcatacactattaagactgaggagcttgtaatcactacacacactgctataggacaagcaatatgcaatgcagctgctacatataaagaaagaaggcagctgactcaattggtcaaaaaaggtacaatatccttagcagattttgaacagaaagaacctgaaataacctacactgaatttgagcctgaaactaggccccaggtggactgcgttactaattacaataatgcagtcagaaatttaggtctttctgcactcgatgaacagcctcaatgttcatcttctaacagtcatataccctgcaatgaaatatctctagcaatgactgatgatgataatgctgcggccattcatgaaattgaatctctattgtctgaaccgataatagctcctcaactcccagcattgccacacaagacatgggctagttatgcttccgacacatcatctatgaagaaccgtgaaattgagaacataattgctgagcttgaaatctcacggaaggaaaacaatgtgcagcaaactactcatgattaccatgctgtttctgatactgctcaaaactctggagatctcccatggaaagcatggattccacttctgaatgcacacggctttaagggagaccaacttcaatacagtcctgatggcaaagtgattcagccaattcaggacatcaataacaaaacaccaagatctgagtacccatccagtattcctgcagatcttgtaactacactgcgaaacattaaaagagcagtgtatgccattcctattagccatcgaagggcaagtgcttacagctctgatatcaagaacaataggactggcaaattgctttgctcccaatcaaaagaatggaaggaaagttttgctttcaaaatgcgacatgaagacatcgttaaatctggagtggtcattcatggctgtggtggctctggaaaatcacaagcattacaaaactttctcagaactcttggcgacaccaacgactgttgcacagtggtggtgccaactgttgagctcagaaatgattgggtgaacaaattgtgcaaactacccatggaacacattaaaacatttgaaaaagcaatgattcaaccaggattcccagtcgttatctttgatgactacaccaaattgccacctggttacattgaagcctatttgttccaccatgccaacaccgaacttttcattctcactggagactcgcggcaaagtgtatatcatgagtccaacaatgaagcatacattgcctccttagatgaagccgttgcttactatgccaactactgcggattttacctaaatgctacacatagaaatgttcgcagtttagccaataagctaggtgtttacagtgagaaagaaggccacctcaaaattacctttgcctcaaatgctctacaaaagtgcaaagtgccaattttagtgccttctaaaatgaagaaaggtgccatgcaagacatagggcacaaagccatgacctacgctggttgtcaagggcttactgctccaagagtccaaattttgcttggcaaccacacacaacactgctcagacagggtgctgtacacatgtctctctagagctgttgattccatccattttatcaatacaggtccaaacaattctgaattttgggacaagctcgaggcaacaccatacctcaaagcatttattgatacttacagagatgagaaaacagaaatgctcaattctaaacctgctgacgacagtcctactgagcctgaagctccattgactcactttccagtgtccaacggcaacaacttggaaaagttagcttcagcacttcctgaaaaatttgcaagggagttgtatgacaaacaccatgggtattctaacacaatccaaactgaaaatccagtggtccaacttttccagcatcaacaagccaaagatgaaacgcttttctgggcaacaatagaagctagactttctattacaactccggaagccaatttacgagaatttgtgctgaagaaagatgttggagacatcttgtttttcaactaccacaatgcgatgtgcttacccgctgatccagtggactttgagccaagaacatgggaaatatgtgctgctgaagttaaaaatacttacttagccaaaccaatggctaacctgatcaatgctgctagcagacaatctcctgattttgatgctaataaaatttccctgttcttaaaatctcaatgggtcaaaaaagtggaaaaattaggtgctgtcaaatcaaagcctggccagactatcgcagctttcatgcaacaaacagtgatgttgtatgggaccatggccagatacctcagaaagatgagacaaagattccaaccaaagcatattttcattaattgtgagacaacaacggatgatctgaaccaatttgttaaacaaggttggaactttaacagaacggctcagacaaatgatttcacagcttttgaccaatcacaagatggtgcaatgcttcaaattgaagtcatgaaggcaaaattcttcaatatccctgctgacattattgaaggatacatcaatatcaaattgaacgccaaaattttccttggtacattgtccattatgaggttgtctggtgaaggtccaacttttgatgctaacacagaatgttcaatagcatatactgctacaaaataccatctcgattccacagtcaagcaggtttatgctggagatgacatggcattagatggagttgtccaagaaaaaccctctttcaaaaatttacagaacaagcttaaactcacctcaaagacactatttccaaagcaggtcaaaggtgattacgctgaattctgtggttggactttcactcctggtggcatcattaaaaaccctttgaaaatgcatgcttcaatcatgttgcaagaggcaattggcaatttgcacactgctgccagatcatatgccattgacatgaagcattcataccaaatgggtgatgagctgcatgattacttaacaccagatgaagctgaacaacatttccttgctgttcggaaattgcacaagctacaccaaggagaagcaatgagacttggtgaaaagagccctccaaaatcaacacattgaggggttaagtttttcccagtttgaaatggaaagatcaactctgattaatttacttcaattgcaccacttcgagccaaaactcagtgttgaaggaatcatagttgtgcacggaattgcaggaactgggaaaaccactttacttaggactttattttctgcttaccctagcttagttataggttcacctaggccttgttatttagacaaacaaaataaaatttcacaagtttgcttatcttgctttcccaatacccattgtgacattgttgatgagtatcatttgctagaaagtttcccagaaccaaaattggctatctttggtgacccctgtcaatgcacatacgttgaaagacttagagtcccacattacacttccttcagaactcatagatttggaaagtcaactgctgagattttgaacaaactgtttgatcttaatataatctcagttaagaaagaagacgacattgttgaattctttaaccctttcgaagttgaccccactgaacatatctcagcctctgaagaagaagtcttagactttgtttctgaccaagtggtgaccaccagctcagaagaactagcaggacttgaatttgctgaaacaactttctactgcaccacactggcagcagccgttgctgaaaatcctgctaagactttcatctctctgaccagacacactcacaaactcaccattggggaactaaatgccaggtctaactcctagagctgacctcactgacacatacaaaatcattgccattgccttcttgttgtcagcctgcatttacttccaaaatagccactaccaacctgttgctggagacaatttgcaccgtttgccttttggtggccaatatcaagacggcactaaaaggatttcttattttccacaacagcagtcatactttcattctggaaacaaattaaatgtcctcatacttatcttcattctcacattgggtattgtcctcaccaataaatttagttttagctttagtcgtactactcaccagcattcttgctataacacacattcagcaaccaacaacacacaaccattgtcaggtcatcattgacggtgctgcaatagtcataacaaattgtgagaacacaccagaagtacttaaggcaatcaacttctccccctggaacgggttaagttttcctaagtttgaaaatcaatattgagtgttcacaacaatcaacttcaacaaacaatcatgcctgacacaacacctgttgctgccacttcaagtgcaccacctacagccaaagatgctggtgccaaagctccttctgacttctcaaatcccaatacagctcctagtctcagtgatttgaagaaagtcaagtatgtctccacagtgacttccgtggccacaccagctgaaattgaagccctaggcaaaatcttcaccgctatgggccttgccgccaatgagactggtccggcgatgtgggatctagctcgtgcgtatgctgatgtgcagagctctaaatccgcacagctgattggtgctaccccttccaaccctgcattatcacgccgagcccttgctgctcagtttgatcgaatcaatataacacccaggcaattttgcatgtactttgctaaagttgtttggaacatccttctcgacagcaatattccaccagcaaattgggctaaacttggttaccaagaagatacaaaatttgctgcatttgacttcttcgatggagtcaccaaccctgccagcctgcagcctgctgatggtctcatcaggcaaccaaatgagaaagaactagctgctcactcagtagctaaatatggcgccttggctaggcaaaagatctccacaggtaattatattaccacacttggagaagtcacacgtggacacatgggtggagctaacaccatgtacgcgatcgacgcaccccctgaactttaaacactcgaaacttaatcagagtggggttttctacagtttattttcctaattatttctttgaaataaaaaaaaaaaaaaaaaaaaaaaaaaaaaaaaaaaaaaaaaaaaaaaaaaaaaaaaaaaa

SEQ ID NO: 362 - DNA, 2965 bp, Tomato spotted wilt virus
agagcaatcgtgtcataattttattcttaatcaaacctcacttagaaaatcacaatactgtaataagaacacagtaccaataaccataatgtcttcaagtgtttatgagtcgatcattcagacaagagcttcagtctggggatcaactgcatctggtaaagctgttgtagattcttactggattcatgaacttggcactggttctccactagttcaaacccagctgtattctgattcaagaagcaaaagtagctttggctatactgcaaaggtagggaatcttccctgtgaagaagaagagattctttctcagcatgtgtatatccctatttttgatgatattgattttagcattaatattgatgactctgttctggcactatctgtttgctcaaatacagtcaatactaacggagtgaaacatcaaggtcatttgaaagttttgtctcttgctcagctccactctattggatctaccatgaacagatctgatattacagaccgattccagcttcaagaaaaagacataattcccaatgacagatacatcgaggctgcaaacaaaggctctttgtcttgtgtcaaagagcatacctataagatcgagatgtgctataatcaagctttgggcaaagtgaatgttttatcccctaacaggaatgtccatgaatggctgtacagtttcaagccaagtttcaatcaagttgaaagcaacaacagaactgtaaattctcttgcagtgaaatctcttctcatgtcagcagaaaacaacatcatgcctaactctcaggcttttgtcaaagcttccactgattctcatttcaaactgagcctctggctaagggtcccaaaggttctgaagcaggtctctattcagaaattgttcaaagttgcaggagacgaaacaaaaacattttatttatctattgcttgcattccaaaccataacagtgttgagacagctttaaacgtttctgttatttgcaagcatcagctcccaattcgtaaatgtaaagctccttttggattatcaatgatgttttctgatttaaaggagccttacaacattgttcatgatccttcatatcctcagaggattgttcatgctctgcttgaaactcacacatcttttgcacaagttctttgcaacaacttacaagaagatgtgatcatctacactttgaacaactatgagctaactcctggaaagttagatttaggcgaaagaaccttaaattacagtgaagatatctgcaaaaggaaatatttcctttcaaaaacacttgaatgtcttccatctaacacacaaactatgtcttacttggacagcatccaaatcccttcctggaagatagactttgccaggggagaaattaagatttctccacaacctgtttcagttgcaaaatctttgttaaagcttgatttaagcgggatcgaaaagaaagaatctaagattccggaaacatatgcttcaggatcaaaataatcttgctgtgtccggtttttctaattatgttatgtttattttctttctttacttataattatttctctgttttgtcatttcttttaagttcctcctgtttaatagaaaccataaaacaaaaaataaaataaaaataaaaataaaatcaaaaatgaaacaaaaatcaaaaaatgaaacaaaaataaaaaataaaaaatgaaataaaaacaacaaaaaattaaaaaacaaaaacccaaaaaagatcccgaaagggacaatcttggccaaatttgggttttgttttgtttttgttttttgttttttgtttttatttttatttttattttatttatttattttattttatttttattttttattttgttttttattttatgtttttttgttgtttttgttatttgtttatttattaagcataacacacagaaagcaaactttaattaaacacacttattttaaatttaacacactaagcaagcacaagcaataaagataaagaaagctttatatatttgtagacttttccataatttaacttacaactgattttaagcaagttctgcgagttttgcctgttttttaaccccgaacatttcatagaacttgttaagagtttcactgtaatgttccatagcaatacttcctttagcattaggattgctggagctgagtatagcagcatactctttccctttcttcacctgatcttcattcatttcgaatgctttgcttttcagcacagtgcaaacttttcctaaggcttctctggtgtcatacttctttgggtcaatcccgaggtctttgtattttgcatcctgatatatagccaagacaacactgatcatctcaaagctatcaactgaagcaataagaggtaagctacctcccagcattatggcaagcctcacagactttgcatcatcaagaggtaatccataggcttgaatcaaagggtgggaagcaatcttagatttgatagtattgagattctcagaattcccagtttcctctacaagcctgaccctgatcaagctatcaagccttctgaaggtcatgtcagtggctccaatcctgtctgaagttttctttatggtaattttaccaaaagtaaaatcactttgtttaataaccttcattatactctgacgattcttcaggaatgtcagacatgaaataacgctcatcttcttgatctggtcgaggttttccagacaaaaagtcttgaagttgaatgctaccagattctgatcttcctcaaactcaaggtctttgccttgtgtcaacaaagcaacaatgctttccttagtgagcttaaccttagacatgatgattgtagaagttgttatatgctttgaccgtatgtaattcaaggtgcgaaagtgcaactctgtattccgcagtcgtttcttagggttttaatgtgatgatttgtaagactgagtgttaaggtttgaataaaattgacacgattgctct

SEQ ID NO: 363 - DNA, 354 bp, Artificial Sequence
  Synthetic sequence: PepMV1/mir159a
cgctttcgcttgcgtttcttggccctgctggtgttgaccggtccgaacgggggcagatcgatgctttgggtttgaagctccattaacaacattgaagtgaagggtcgttccgaagggctggttccgctgctcgttcatggttcccactatcctatctcatcatgtgtatatatgtaatccatgggggagggtttctctcgtctttgagataggcttgtggtttgcatgaccgaggagctgcaccgcccccttgctggccgctctcttcattgtagttaatggagcatcctgatccacccctccattttttttgcttgttgtgtccttcctgggacctgagatctgaggctcgtg

SEQ ID NO: 364 - DNA, 236 bp, Artificial Sequence
  Synthetic sequence: PepMV2/MON5
cgaagagctgggaacgggagattggagcaatcagaatttgtaaccacctttgctcttccaagcaatgtgtgctggtgcaatgcatttaatttcttggaagaggaaaaggtggttatgatttctgatgattctttcctttccttttgctttttgcaatacgcaatatgcatgtaccttatttttcattccatcctcattattctatgctaatggatagtacttccttcttctccatg

SEQ ID NO: 365 - DNA, 295 bp, Artificial Sequence
  Synthetic sequence: PepMV3/MON13
ggcagagccgtgcccgtctcatcccctgcccgtgcaagcagctaggtaggacgatttgagcgtggtgttaggccgaaccgctgaaggaagattgctccactgttgactgcattcaatcatgcacctccagtcgaaatgtattgcttatattcagcaatataatgttccgactggagatccatgattgaatatagtcgatagtggaagaacggtaacatatgtggtttgcagcaggtgagcaggatgggtgtggatgattgaatatctctgttcagtgttttcatcatctgactga

SEQ ID NO: 366 - DNA, 336 bp, Artificial Sequence
  Synthetic sequence: Pepv4/MON1
aattcattacattgataaaacacaattcaaaagatcaatgttccacttcatgcaaagacatttccaaaatatgtgtaggtagaggggttttacaggatcgtcctaagtagcaaggcctaggtgaccacatgatgcagctatgtttgctattcacctaggcctggcgacttaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 367 - DNA, 295 bp, Artificial Sequence
  Synthetic sequence: Gemini2/MON13
ggcagagccgtgcccgtctcatcccctgcccgtgcaagcagctaggtaggacgatttgagcgtggtgttaggccgaaccgctgaaggaagattgctccactgttgactgcattggactttacatgggccttcaaaatgtattgcttatattcagcaatataatgttctgaaggcccctataaagtctaatatagtcgatagtggaagaacggtaacatatgtggtttgcagcaggtgagcaggatgggtgtggatgattgaatatctctgttcagtgttttcatcatctgactga

SEQ ID NO: 368 - DNA, 336 bp, Artificial sequence
  Synthetic sequence: Gemini3/MON1
aattcattacattgataaaacacaattcaaaagatcaatgttccacttcatgcaaagacatttccaaaatatgtgtaggtagaggggttttacaggatcgtcctacatgccatatacaatagcaccacatgatgcagctatgtttgctattgctattgtatacggaatgtaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 369 - DNA, 354 bp, Artificial Sequence
  Synthetic sequence: Gemini5/MIR159a
cgctttcgcttgcgtttcttggccctgctggtgttgaccggtccgaacgggggcagatcgatgctttgggtttgaagacggattcacacactggggatgaagggtcgttccgaagggctggttccgctgctcgttcatggttcccactatcctatctcatcatgtgtatatatgtaatccatgggggagggtttctctcgtctttgagataggcttgtggtttgcatgaccgaggagctgcaccgcccccttgctggccgctcttcccctgtgcgtgaatccgtcatcctgatccacccctccattttttttgcttgttgtgtccttcctgggacctgagatctgaggctcgtg

SEQ ID NO: 370 - DNA, 350 bp, Artificial Sequence
  Synthetic sequence: TospoL1-1/MIR167g
acgagagggtatgtagtggtgcaccacgagttggtttaggcatcatatagatagctttctgatggtggtggtatatgtaagatggatgtaatctatactacggcccctgttaatttctctctctctccccggtccctgactgtcatatatggatcgacgaatccaagatgagaggggaatggagagagagagagagggtaattatgagcaccaggaagctgtctatatgtgcctaaatctgctggtggccgcacatcgaaaaccctagctagctctagtagctagctcatcctcgtgcaattcatatccatgctgcactcgccagaccaccagtcaagctagcttatttc

SEQ ID NO: 371 - DNA, 336 bp, Artificial Sequence
  Synthetic sequence: TospoL1-2/MON1
aattcattacattgataaaacacaattcaaaagatcaatgttccacttcatgcaaagacatttccaaaatatgtgtaggtagaggggttttacaggatcgtcctgatttaggcatcatatagatccacatgatgcagctatgtttgctatatctatatgatgacttaatcaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 372 - DNA, 336 bp, Artificial Sequence
  Synthetic sequence: TospoM2/MON1
aattcattacattgataaaacacaattcaaaagatcaatgttccacttcatgcaaagacatttccaaaatatgtgtaggtagaggggttttacaggatcgtccttagtttgcaggcttcaattaccacatgatgcagctatgtttgctattaattgaagcctccgtattaaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 373 - DNA, 295 bp, Artificial Sequence
  Synthetic sequence: TospoM3/MON13
ggcagagccgtgcccgtctcatcccctgcccgtgcaagcagctaggtaggacgatttgagcgtggtgttaggccgaaccgctgaaggaagattgctccactgttgactgcatttgcatgcttcaatgagagctaaatgtattgcttatattcagcaatataatgttcagctctcataacagcatgtaaatatagtcgatagtggaagaacggtaacatatgtggtttgcagcaggtgagcaggatgggtgtggatgattgaatatctctgttcagtgttttcatcatctgactga

SEQ ID NO: 374 - DNA, 236 bp, Artificial Sequence
  Synthetic sequence: TospoS2/MON5
cgaagagctgggaacgggagattggagcaatcagaatttgtaaacaccatggtaacgtcaagcaatgtgtgctggtgcaatgcatttaatttcttgacgttagacatggtgtttatgatttctgatgattctttcctttccttttgctttttgcaatacgcaatatgcatgtaccttatttttcattccatcctcattattctatgctaatggatagtacttccttcttctccatg

SEQ ID NO: 375 - DNA, 295 bp, Artificial Sequence
  Synthetic sequence: TospoS3/MON13
ggcagagccgtgcccgtctcatcccctgcccgtgcaagcagctaggtaggacgatttgagcgtggtgttaggccgaaccgctgaaggaagattgctccactgttgactgcattagaaagttttgaagttgaataaatgtattgcttatattcagcaatataatgttcattcaacttaacaactttctaatatagtcgatagtggaagaacggtaacatatgtggtttgcagcaggtgagcaggatgggtgtggatgattgaatatctctgttcagtgttttcatcatctgactga

SEQ ID NO: 376 - DNA, 247 bp, Capsicum chlorosis virus
agagcaatcgagcaacaaattaaagtattctaaactcagtttcaatattaataagaaatactatttctgacactaatgtctggtttagaacttgcaactagactgcatcctattatgatgcaatctgtttttaaaccttttccaagaattatacaattggcagctttgcgctcttttcttgttttagaatctgtactaaatattctattatcggttattatactattgcccataaattatttacatt

SEQ ID NO: 377 - DNA, 56 bp, Capsicum chlorosis virus
agagcaatcggtgcgtcaattactagataaaatcatcaaataataaacaagaaata

SEQ ID NO: 378 - DNA, 66 bp, Capsicum chlorosis virus
agagcaatcggggcatctaataattctagaaaaacaacgatatactcaagaaatactatttcaggc

SEQ ID NO: 379 - DNA, 350 bp, Tomato yellow leaf curl virus
ttaataaaatttatattttatatcatgagtttctgttacatttattgtgttttcaagtacatcatacaatacatgatccactgctctgattacattgttaatggaaattacaccaagactatctaaatacttaagaacttcatatctagatactcttaagaaacgaccagtctgaggctgtaatgtcgtccaaattcggaagttgagaaaacatttgtgaatccccattaccttcctgatgttgtggttgaatcttatctgaatggaaatgatgtcgtggttcattagaaatggcctctggctgtggtctgttatcttgaaatagaggggattgtttatctcccagataa

SEQ ID NO: 380 - DNA, 350 bp, Tomato yellow leaf curl virus
gctgtggtctgttatcttgaaatagaggggattgtttatctcccagataaaaacgccattctctgcctgaggagcagtgatgagttcccctgtgcgtgaatccatgattattgcagttgaggtggaggtagtatgagcagccacagtctaggtctacacgcttacgccttattggtttcttcttggctatcttgtgttggaccttgattgatacttgcgaacagtggctcgtagagggtgacgaaggttgcattcttgagagcccaatttttcaaggatatgtttttttcttcgtctagatattccctatatgaggaggtaggtcctggattgcagaggaagatagtggg

SEQ ID NO: 381 - DNA, 350 bp, Tomato yellow leaf curl virus
tattccctatatgaggaggtaggtcctggattgcagaggaagatagtgggaattccccctttaatttgaatgggcttcccgtactttgtgttgctttgccagtccatctgggcccccatgaattccttgaagtgctttaaatagtgcgggtctacgtcatcaatgacgttgtaccacgcatcattactgtacacctttgggcttaggtctagatgtccacataaataattatgtgggcctaaagacctggcccacattgttttgcctgttctgctatcaccctcaatgacaatacttatgggtctccatggccgcgcagcggaatacacgacattctcggcgacccactc

SEQ ID NO: 382 - DNA, 350 bp, Tomato yellow leaf curl virus
ggtctccatggccgcgcagcggaatacacgacattctcggcgacccactcttcaagttcatctggaacttgattaaaagaagaagaaagaaatggagaaacataaacttctaaaggaggattaaaaatcctatctaaatttgaacttaaattatgaaattgtaaaatatagtcctttggggccttttcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgt

SEQ ID NO: 383 - DNA, 335 bp, Tomato yellow leaf curl virus
ccaaaatcaatgaagtctccgtctttctccacgtaggtcttgacatctgttgagctcttagctgcctgaatgtttggatggaaatgtgctgacctgtttggggataccaggtcgaagaaccgttggttcttacattggtatttgccttcgaattggataagcacatggagatgtggttccccattctcgtggaattctctgcaaactttgatgtattttttatttgttggggtttctatgttttttaattgggaaagtgcttcctctttagagagagaacaattgggatatgttaggaaataatttttggcatatattttaaataaacgaggcat

SEQ ID NO: 384 - DNA, 350 bp, Tomato yellow leaf curl virus
tttgatattgaatcatagaaatagatgcgtattttcatagttgcatacactggattagaggcatgcgtacatgccatatacaataacaaggcgttttcagtatggttctcgtacttggctgcctcctgatgattataagttacatgactgttaattttaaaaaatctcttaactaatgcctgttccttcattccagagggcccaccaataactgtagcatgaaatttcctcatcacttgaaacctatcacgcaaatcattcttcacagttgcggtactgggctcattatcgaacatattaaaaacctgtccaaaatccattggactgcttccatagggccttctatcacg

SEQ ID NO: 385 - DNA, 350 bp, Tomato yellow leaf curl virus
aaaacctgtccaaaatccattggactgcttccatagggccttctatcacggaccaaaaagaacatgacctgattagtgtgattctgcttcttgatattttcatccatccagactttacctaaaaaatatatcgatttaacacagaacctcttaccgactctgtgagtaattccagatccacgagtaacatcactaacacaacgaacaacaccagtgtgcttaatatcatcccgctgctcataagactggactttacatgggccttcacatccacggggaacatcagggcttcgatacattctgtatattctgggctttcggtacatgggcctgtacgtccatgatcgtcg

SEQ ID NO: 386 - DNA, 333 bp, Tomato yellow leaf curl virus
ctgtatattctgggctttcggtacatgggcctgtacgtccatgatcgtcgcttgtttgtgccttggacaatggggacagcagcacggttgctgtatgggctgtcgaagttcagccttcggcgaaccttcgagacgggcgtggaaatgattatatcgcctggtcgcttcgacatagtcacgggcccttacaacagatataagatccctaattaaatcgtggcccaatgtattgggctcgtaagtttcctcaacggactgcaaatatttaatagctaacatacaacgaaatccgtgaacagattcaggaaattcatttagaagtgggtcccacat

SEQ ID NO: 387 - DNA, 340 bp, Tomato severe leaf curl virus
taaaatttgaattttattgaatgattttccagtacatgagatacatacgacctgtttgtcgcgaatcgtacagctctgataacattgttaatgcaaataacacctaacctatctaaatacaataagactaaatatttaaatctacttaagtaagtcgtcccagaagcttgaactgatgtcgtccagatttggtagttgaggtaggctttgtgtagactcagcgccttcctgaggttgtggttgaaccgtatttggatgtggtatatcctggtgttgctgtaaattgggtcctctacattgattatcgtgaaataaaggggatttggtacctcccagataa

SEQ ID NO: 388 - DNA, 335 bp, Tomato severe leaf curl virus
ctctacattgattatcgtgaaataaaggggatttggtacctcccagataaaaacggaattctctgcctgatccgcagtgatgctctcccctgtgcgtgaatccatggttggcgcagtcgatgtgctggtagaacgagcagccacagtttaggtctattctctttcgacgaatcctggactttgcaattttgtgtttaggcttgatagagggtggagttgaggaagatgaattttgcattgtggagtgtccaatcttttagtgctttgttttcctctttttcgaggaaacttttatagctggccccctcaccaggattgcagagcacgattgacgg

SEQ ID NO: 389 - DNA, 359 bp, Tomato severe leaf curl virus
aaacttttatagctggccccctcaccaggattgcagagcacgattgacggtattccccctttaatttgaactggcttcccgtatttgcaatttgattgccagtccttttgggccccaatcagctctttccaatgcttcatctttaaatattgcggagtgatgtcatcaatgacgttgtattccgcttcatttgagtaaaccctagaattgaaatctaggtgtccactcaaataattgtgtgggcctaaggcacgcgcccacattgtctttcccgtcctcgattcaccctcgatgattatacttataggtctctccggccgcgcagcggcatccctaccaaaataatcatctgcccattc

SEQ ID NO: 390 - DNA, 338 bp, Tomato severe leaf curl virus
ctctccggccgcgcagcggcatccctaccaaaataatcatctgcccattcttgcatctcgtccggaacgttcgtgaacgacgagagtggaaacggaggaacccagggttccggagccttttgaaagagccgctcgatgttagctttgacgttatggtagcttacaatgaacgtctttgggtctccggcccttataatgtcgagagcctctccagcactagctgcattgacggcgttgtggtagacgtcgtctttgtttgattttgtacccccagacaccttgtattgtccggattcacaataatcaccttctttggtgatgtaattctggacggcgtt

SEQ ID NO: 391 - DNA, 347 bp, Tomato severe leaf curl virus
ccggattcacaataatcaccttctttggtgatgtaattctggacggcgttggtgtctttggctgcctgtgcgtttggatgaaaattggcagaccttctggggtgagtgaggtcgaaaaatctagcatccttgatgttggacttcccggagagttggatgagacagtggaggtgcggaaatccatctgcgtgttcctctctggcgactcgtatgtacgttggtttgacgactgaccatggcagattttgaagcatttcaatagcttcatctttggggatatcacactgtggatatgttaagaaaatatttttggcagctagacgaaataaattagggttccgtggcat

SEQ ID NO: 392 - DNA, 351 bp, Tomato severe leaf curl virus
ttaattcaataccgaatcataaaaatagatccggatcttaagagtagcatacacagggttagaggcatgagtacatgccatatacaataacagggcgttctccgtgtgattctcatacttgccagcctcttggtgattgtagaccacatggttgttgaccctccagaatcgcttgactatagcctgctcgttgctggcatactgtccacctgtcaccttgccatagaacttgtgcatgacctggtaacgatcgcgtagatcggtcttgaccgtggcagtgctgggctcattgtcaaacatgttgaacacctggccgaaatccataggcgtaccatagggtctacggtccct

SEQ ID NO: 393 - DNA, 333 bp, Tomato severe leaf curl virus
ttgaacacctggccgaaatccataggcgtaccatagggtctacggtccctgactaaccagaacatgacactgttcgtgtggttcttcagcttgatgttctcgtccatccatatcttaccgaggatatacacagacttaacacaaaaccgcttaccaacacggtgggtgataccattaccacgtgtgacatcggatatgcacatgaccttccccacgtgggagatatcgtgtcgttgctcgtaggactggaccttacatgggccttcacagccccttggaacgtcgggcgttctccaagcccgatatatcctgggcttcctatacatgggcctg

SEQ ID NO: 394 - DNA, 172 bp, Tomato severe leaf curl virus
cgggcgttctccaagcccgatatatcctgggcttcctatacatgggcctgttaacccaggcatgggccttatcaaatttaggcccagtaccagtccggggagactggttggaggaccgactcaccttaggggtacccgccattaagcgccatggggcatcacgcttaggcat

SEQ ID NO: 395 - DNA, 350 bp, Pepper golden mosaic virus
ttaataaagtttgcattttatttcatgattctcaagtacataatttacataggatttgtccgtcgcaaaacgaacagctctgattacattgtttatgcctatggcccctagcgtatgtaaatacaacatgacgcgaaatttgaatctacttaaatatgtcgtcccagaagctgtcatcgaagtcgtccagacttggaaatggaggaatgccttgtggagagctaatgctcgacgtaggttgtggttgaaccggactacgatgtggtatatcctggttctggtgaacaacgggtcctccacgtgctgtatcctgaaaaataggggatttggaacctcccaaataaaaacgg

SEQ ID NO: 396 - DNA, 350 bp, Pepper golden mosaic virus
gtgctgtatcctgaaaaataggggatttggaacctcccaaataaaaacggaattctctgcctgatgcacagtgatgctctcccctgtgcgtgaatccattattagcgcagttgatgtggagaaagatagagcagccgcagtttaggtctatgcgtcgtctgcgaataggtcgcttcttagctatcctgtgctgtgcttttatagaggggagcgtggaggatgacgaattgagcattttttaatgtccacgctcttaattctgcattttcctctttgttgaggaaagctatatagctgctaccttcccctggattgcacagcacgattgatggtatcccgcctttaatttg

SEQ ID NO: 397 - DNA, 350 bp, Pepper golden mosaic virus
ccttcccctggattgcacagcacgattgatggtatcccgcctttaatttgaactggctttccgtatttacagttggactgccagtctttttgggccccaataagctctttccagtgtttcatctttagatattggggcgtgatatcatcaatgacgttatactccacatagtttgaatagacctttgcattgaaatcaagatgaccgctcaaataattatgtgggcctagtgcacgtgcccacattgtcttgccgcatcgcgaatcaccctcaatgacaatactaatcggtctatctggccgcgcacaactccgaccaaaatattcagcaacccaatgttgcatatcctc

SEQ ID NO: 398 - DNA, 350 bp, Pepper golden mosaic virus
cgcgcacaactccgaccaaaatattcagcaacccaatgttgcatatcctcaggaacgttgttaaacgaggataatggataaggaggagtccatggcataggaggagttgtaaataggcgctcgatgttagcctttatgttatgataactaacaatgaacgttttcggatcaccagctttgattatgtcgagcgcctcccccgcacttgcagcatttacagcgttatggtagacgtcgtctttatttgcttttgaccccccggaaactttgtactgcccagattcacaataatcaccatcttttgttatgtaatttttaacggcatttgcgtccttggatgcctgaacgtt

SEQ ID NO: 399 - DNA, 323 bp, Pepper golden mosaic virus
tttgttatgtaatttttaacggcatttgcgtccttggatgcctgaacgtttggatgaaactgggcagatctccgggggtgagtaatgtcgaagaaccgggcatctttgatgttgcattttccagtcaactggattagacagtgcaagtgcgggaacccatcggaatgctcctctcgtgatacccggagatagatgggttttaccactgcccattttaaattacggagcatttcgagagcttcatcctttgggatatcgcattgtggatatgttaagaaaatgtttttacattgtaaacgaaaggattttggtggtagtggcat

SEQ ID NO: 400 - DNA, 350 bp, Pepper golden mosaic virus
ttaatttgttatcgaatcataaaaatagattcgaattttcaatgtcgcgtacacagggttagaggcatgtgtacatgccatatacaatagcagggcgttctcagtatgattctcgtatttgccagcttcctgatggttgtacacgacgtagttgttcaccttccagaaacgcctaaccaatgcctgctcgttgctggcatactgtccacctgtgaccttagccgagaacctgtgcatgacttggaaacgatcacgcaaatcgttcttcacagtagctgtactgggctcgttgtcatacatgttgaacacctgaccaaagtccataggggtaccatatggtctcctatctc

SEQ ID NO: 401 - DNA, 350 bp, Pepper golden mosaic virus
gttgaacacctgaccaaagtccataggggtaccatatggtctcctatctctcacgagccagaacatgacgctgttggtgtggttcttgagcttgatattctcgtccatccatatcttacccagaacgtatgcagacttgacgcagaaacgcttgcctacacgatgggtaataccattaccacgtgtcacgtcagaaatgcacatgaccttgccaacatgcgagatatcatgccgctgctcgaaggactggaccttacatggcccttcacatsstctaggcacatctgggcttctatacgtacgatatatactgggcttcctgtacatgggcctgttaacccaagcagcgg

SEQ ID NO: 402 - DNA, 156 bp, Pepper golden mosaic virus
acgatatatactgggcttcctgtacatgggcctgttaacccaagcagcggccttatcgaatttaggccccatacccgtgccacgtgaataattcgcagagccggaaaccttagaggtccccgccattaaacgccatggggcatcccgcttaaccat

SEQ ID NO: 403 - DNA, 350 bp, Pepper huasteco yellow vein virus
ttaataaagtttgtatattatttcatgattctcaagtacagcattgacataacgtttgtctgtagcaaacgaaacagccctaattacattgttaactgaaataagacctaagttatctagataaaacatgacaagcaatttaaatctatttaagtaaatctgcccagaaatcgtcgtcaacgtcgtccagacttggaagttgaagtaggctttgtggagacccaacgctgtcctcatgttgtggtttgctctgacttgaatgtgaaatacccggctgcgtgtgtacattggcgtctccactagccgtattttgaaatataggggatttcgaagctcccagataaaaacgc

SEQ ID NO: 404 - DNA, 350 bp, Pepper huasteco yellow vein virus
tagccgtattttgaaatataggggatttcgaagctcccagataaaaacgccattcgctgcttgagctgcagtgatgggtaccccggtgcgtaaatccattgttaacacagttaatatgtatataaattgaacagccgcaagcgagatcaatccttctacgtcgtatctgtctctttgcaaatctatggcgaagtttgacttccggtggtgaagatagcttcttcgatggtgacgtagatggcgtttttttggacccagtcattgaggctcctatttttctcttcgctgaggtagtctttataggaagactgggggcccggattgcaaagaaagatagtgggtatcccacc

SEQ ID NO: 405 - DNA, 350 bp, Pepper huasteco yellow vein virus
taggaagactgggggcccggattgcaaagaaagatagtgggtatcccacctttaatttgaattggtttgccgtatttgcagtttgattgccaatcccgttgggcccccataaactctttaaagtgcttaacataatgcggagggatgtcatcaatgacgttataccatgcattattggagtagatttttgggctgagatccatatgaccacatatgtaattgtgtgggccgagacttcgggcccataatgttttgcctgtccgtgaaggaccctcgaccactaatgacaatggtctcattggccgcgcagcggcatcacatacattatcagacacccattgtgtcattat

SEQ ID NO: 406 - DNA, 350 bp, Pepper huasteco yellow vein virus
ggccgcgcagcggcatcacatacattatcagacacccattgtgtcattattgcaggcacattattaaaggacgcctgttgaaatggaggaacccacggttccgggggagtttggaatatccgattagcgtttgacacaatgttatgaaattggaggaagaaatgctgaggttgttcttcctttatgatctgcagagcttcttctgcagatgctgaatttaacgccttagcatatgtgtcattagcagactgctgtcctcctctagcagatctgccgtctatttggaattctccccattctacggtatcgccgtctttgtcgatgtacgtcttgacgtcggagcttgattt

SEQ ID NO: 407 - DNA, 332 bp, Pepper huasteco yellow vein virus
acggtatcgccgtctttgtcgatgtacgtcttgacgtcggagcttgatttagctccctgaatgttcggatggaaatgtgctgatctggtagaggatacgaggtcaaagaatcggttgttcgtgcattggtattttccttcgaactgaataagcacgtgcagatgaggttgcccatcttcatgagattctttgcaaattttgatgtacttcttgtttaccggcgtcgagaggttttgtagttgagcgagacgctcttctttggaaatggaacattgtggataggtgaggaaataattcttggcatttaaacgaaatcgtttaggtaatggcat

SEQ ID NO: 408 - DNA, 350 bp, Pepper huasteco yellow vein virus
ttaattcattatcgagtcataaaaatagacccgaattttgagtgttgcatacacgggattagatgcatgagtacatgccatatacaataacagcgcattctccgtgtggttctcatatttcccagcttcttgatggttatacacaacatggttgttcaccttccagaaacgcctaaccaaggcttgctcgttgcttgcatattgcccaccagtgaccttagcatagaatctatgcataacttgataacgatcccgaagatcgttcttcacagtagcggtactgggctcgttgtcatacatgttaaagacttggccaaaatccataggcgtaccgtagggtctcctatccc

SEQ ID NO: 409 - DNA, 350 bp, Pepper huasteco yellow vein virus
gttaaagacttggccaaaatccataggcgtaccgtagggtctcctatccctaaccaaccaaaacatgacactgttggtatggttcttcaacttaatattttcatccatccagattttgcccagaatatagacagacttaacgcagaatcgtttgccaacacgatgggtaataccattaccacgagttacgtcggatatacaaataaccttaccaacatgagagacgtcatgtcgttgttcaaacgattgaaccttacagggaccttcacaacctttcggcacatccggagttctgtacatacgataaatccggggcttcctgtacattgggcgattaacccaagctgagg

SEQ ID NO: 410 - DNA, 156 bp, Pepper huasteco yellow vein virus
acgataaatccggggcttcctgtacattgggcgattaacccaagctgaggccctgctagtactcgggcccatgataagagcccgtgaattattgccagttcggctaatcttggcggtccccgccgttaatcgccaaggagcatcacgcttaggcat

SEQ ID NO: 411 - DNA, 350 bp, Tomato leaf curl New Delhi virus
ttaataaatatccagttttatatcatacgaagtccatacatcaattgtttgctccaatacattatccaatacatgataaactgctcttattacattataaattcctatgacacctaacatatccaggtacttaaggacctgggttttgaagactctcaagaaaatcccaatctgagggcgtaagcccgtccagattttgaaagttagaaaacacttgtgaagtcccagggctttccgcaggttgtggttgaactgtatttgaatcttgattatgtcgtgctgtgttaggaagggcctgctgtcgtgtttcaaaattttgaaatacaggggatttcgaatttcccaggtat

SEQ ID NO: 412 - DNA, 350 bp, Tomato leaf curl New Delhi virus
gtcgtgtttcaaaattttgaaatacaggggatttcgaatttcccaggtatatacgccactctctgctcgatccgcagtgatgtattcccctgtgcgtgaatccgtgatcatggcagttgatcgatatgtaatacgaacaaccacacggtagatcaactcgcctcctgcgaatgctcttcttcttcttctgggagagcgatgttttcgcgaccggaatagagtggttcttcgagtgtgatgaagactgcattcttgattgcccactgcttcagtgctgcatttttttcttcatccagatattccttatagctgctgtttggacctttattgcacaggaagatagtgggaat

SEQ ID NO: 413 - DNA, 350 bp, Tomato leaf curl New Delhi virus
tccttatagctgctgtttggacctttattgcacaggaagatagtgggaattccacctttaatcatgaccggctttccgtacttcgtgttgctttggcagtcacgctgggcccccatgaattctttaaagtgctttagatagtggggatcaacgtcatcaatgacgttgtaccaggcatcattgctatagacctttgggctcagatcaagatgtccacacaagtaattgtgtggtcctaagcaccgagcccacatcgttttgcccgtcctactatccccctctatgactatgcttatgggcctaaaaggccgcgcagcggcacacacaacattagacgagacccaatcgac

SEQ ID NO: 414 - DNA, 350 bp, Tomato leaf curl New Delhi virus
ctaaaaggccgcgcagcggcacacacaacattagacgagacccaatcgacgaggtctgccggaactctgtcgaaggatgaaattgaaaatggagaaacataaacctcggaaggaggttgaaaaatacgatctaaattggtatttaaattgtgaaactgcagaacgtaatcttttggggctaattcctttaatactctcaaagcatcgtctttatttcccgtgttaatcgcctgggcatatgcatcgttcgccgtttgttgaccaccacgggcagatcgtccatcgatctggaaaacaccccattctagaacgtctccatctttggcgatgtagtttttgacgtccgacgc

SEQ ID NO: 415 - DNA, 338 bp, Tomato leaf curl New Delhi virus
cattctagaacgtctccatctttggcgatgtagtttttgacgtccgacgctgatttagctccctgaatgttcggatggaaatgtgctgaccgacttggggaaaccaagtcgaagaatctgttatttttgcactggaatttcccttcgaattggatgagaacatggatatgcggagacccatcttcgtgaagctctctacagatcttgatgaatttcttcttcgtcggggtttctagggtttgcaattgggagagtgcctcttctttagttagagagcactttggatatgtgaggaaatagtttttggcatttactctaaaacgacgtggcgaagccat

SEQ ID NO: 416 - DNA, 350 bp, Tomato leaf curl New Delhi virus
ttaatttgtggccgaatcataaaagtagatccggattttcaaagtagcatatacaggatttgatgcgtgagtacaggccatatacaacattaatgcgttttcagtatgattctcatacttgccggcctcttgttgattataaacaacataattattaaccctaacaaacttcctaactaatgcttgctccttagatgcatatgttcctcccgtcacagtcgcatgccacttccgtaagacttgataacgatcacgatgcatgttcttcaccgttgctgtgctcggttcattgtcaaacatattaaacacttccccgaaatcctggggagatcctgtaggacgacggtcac

SEQ ID NO: 417 - DNA, 350 bp, Tomato leaf curl New Delhi virus
attaaacacttccccgaaatcctggggagatcctgtaggacgacggtcacgaaccagaaaaaacatgacactgttagtatggttttttgtcttgatgttttcatccatccatatctttcccagcacatagacagatttcacacagaatcgcttccctacgcgatgtgtgagtccagttcctcgggtaacatcactaacacacatgactttgccaatatgagagacatcgtgcctagattcaaaggactgcactttacaagggccttcacagccccttggcacgtcgggacttctatacattctgtacattctgggttttctgttcatcggcctgttggtccaggcctttg

SEQ ID NO: 418 - DNA, 410 bp, Tomato leaf curl New Delhi virus
tctgtacattctgggttttctgttcatcggcctgttggtccaggcctttgctttggtgacgcgggcaatggggacaactgcacgagctccataggggctgtcgaagttgagacgtcggcgtaccttcgatgcgggcgttgaaatgatgatatctgctggtcgcttcgccatagttctttgctcggagaacaagaatgagatctcgaataagatcgtagccgactgtgtctggtgaatagttcttttctatctcttggagatattttacagctagcatgcaccttagaccatgaacgctttcgggaaattcgtgcaataatggatcccacatgtttgtggatccaaacttggtgagcaagtctatttattgatccccacgcactaaataggccatgtagcgtgaatttcat

SEQ ID NO: 419 - DNA, 450 bp, Tomato spotted wilt virus
gcaagcaagttctgcgagttttgcctgctttttaaccccgaacatttcatagaacttgttaagagtttcactgtaatgttccatagcaacactccctttagcattaggattgctggagctaagtatagcagcatactctttccccttcttcacctgatcttcattcatttcaaatgctttgcttttcagcacagtgcaaacttttcctaaggcttccttggtgtcatacttctttgggtcgatcccgaggtccttgtattttgcatcctgatatatagccaagacaacactgatcatctcaaagctatcaactgaagcaataagaggtaagctacctcccagcattatggcaagtctcacagactttgcatcatcgagaggtaatccataggcttgaatcaaaggatgggaagcaatcttagatttgatagtattgagattctcagaatt

SEQ ID NO: 420 - DNA, 377 bp, Tomato spotted wilt virus
aaaggatgggaagcaatcttagatttgatagtattgagattctcagaattcccagtttcttcaacaagcctgaccctgatcaagctatcaagccttctgaaggtcatgtcagtgcctccaatcctgtctgaagttttctttatggtaattttaccaaaagtaaaatcgctttgcttaataaccttcattatgctctgacgattctttaggaatgtcagacatgaaataacgctcatcttcttgatctggtcgatgttttccagacaaaaagtcttgaagttgaatgctaccagattctgatcttcctcaaactcaaggtctttgccttgtgtcaacaaagcaacaatgctttccttagtgagcttaaccttagacat

SEQ ID NO: 421 - DNA, 450 bp, Capsicum chlorosis virus
tcacacttctatagatgagctaggtttggagctcttctttgaatgttcaccgtaatcatccacagacaaattagcactgaaagccttatccatgtatttaacttgttcatcatacttcttaagtgaaatagagctagcagtaccagggttactttcgcttaacaacttgacagcttgtttgaacaacctgtctagatcttccttaaattctacttgagaagcagaaagaactttagccactttgcaaacctgctcataagtagagaaattcttaatgcctagcttctcttttttgacattttgataataagccaacgggaagatgactggtgcaaggcctctaatgctggacaaaagaggtaggggtcccccaatgcatagcatcatcctaagagcacaagagtcatatgaagtaggcacattcaacccataagcagctactaatggcaa

SEQ ID NO: 422 - DNA, 428 bp, Capsicum chlorosis virus
cagtcatatgaagtaggcacattcaacccataagcagctactaatggcaattccatcacctttgcatacatttcctgcctggcagcttcatttttgcttttctctaccatgttgaccatctttactcttatcagagcctctgttctcttaaaagtccaatcttctggaccaacctcagcagctgtagaaacaatagttttatcacaaaatttatacttaccacttttgcaagcagcaaaaatctgttttctgcattttaagatattcaagcaatttgtgaaagtcatttcaacacccttgttattatcataaaatgtcttgaagttgaatcctggagttgaatcatcagtttctatttcaacatctgcagtaccaccagccaagagttccctaattttcttttcggtaagttgcctgacgttagacat

SEQ ID NO: 423 - DNA, 550 bp, Capsicum chlorosis virus
ggacctaaaaatgttcccagttggtcagacttaaaagaacaagtatccatcataagccttgatgagaaagttgtatcagaagtataagttatattgcaatcaatccctgcagcacactgagaacacccagagcatatcattttagcctccgagataataggttttgtagggatttttttgaacatttccttaggcatgtctataaccattttaagtttacctaccaggaaatcctttcccatatataatttgttgttgttttcatctatttgagtagcatcttttgatgtagataaactatagatattactatatgtatacaatccacattgtctgatgttaaccttcttttctcctacagcactgcaactccaagtgaagtcttttggtgataaagttgtaggaacagataatggtattccatccgccgtaatttggggatgtccaaatgatgatcctgcaaaatctcctagatcagctatattcccagtaagaattttctgctgcttatctactgcaaacaatttgtctgtgctcatgtaatcgttgt

SEQ ID NO: 424 - DNA, 500 bp, Capsicum chlorosis virus
ctgctgcttatctactgcaaacaatttgtctgtgctcatgtaatcgttgtgcaaatcaactgacatgtcaagctggtaataatcagtttgaataggagatctatcagaatgttttttacaagagtatccatctaatgatttaacacatatttctgcagtgacatgactttcaataacctgatatatgttgaccaagcttgatagatcataaatattggtgcaatgcccgcaaattcctccttcatttattgctaaacagccaagctcttcacaaccccaccaagaagtcagtgtaacacaaaaatctaacattcctaccttaggtttttgtttaatgcaatcagtgcaggcacctgtgcatgttaccagataatctgctacagttgtatctacttttgctgtagaatacttgtatcttacatcatactctacacctacactctttacataaaccataaactccatgggagagtgagtagcatcatcattaagcaaatata

SEQ ID NO: 425 - DNA, 500 bp, Capsicum chlorosis virus
aagatagcactcttcagcatggtctttagatgcctcattttggttgcaaacacacttgtctgtacaagagtgggtcaaaaacgagaaacaaccacaaattctacacttcaaggggaaatatggccacaaccagttaataatccataaaatagggtatgttaaaatgccaaggatatcataccagagacttaatgcatttttagtcttccagatgagccatgatataggaaatgcgatcatgagaaacacaaaaacccatttgaaataagaaaaatttgtgcagaaaaagattttcttaggctcgtttgagtactttgaaacgcaattacgtaccggtatgtctactttagcaatcaagctggatttgtcaccacaaagcaaaaaatggttaccatctaattcttcaggcttaaaatttattgtggaatcgccaatgatagattttatgttttcgagcttcgagctttttatattttttattaaaatcccaatgttttcct

SEQ ID NO: 426 - DNA, 500 bp, Capsicum chlorosis virus
tatgtcgttctcctcaccaggtaacattgagtatatgcttaatgactggacctgtattgctgcataagaaaaaggtattaattcgtttggacaaccttttcttaaaagcatggtaatatggatagagagagacattaagtcatcaaaatagctattatgggagctttcagtactgcaattggccaaatgcctgcaatataaaggaatgacagcaccatttattattctttctgatataaattcaacttctgattctgaagcatagctttttttgggattgagcgttatgcaatagctcttgaaatgtgattgtatgcttctgaaaagcaattctgacaaactagaacaattgaagttcaataacaattccttaatgttccctctgaccaccattgatgttgcattgtcatcagaatgaaccatccaccttatggtgaagtcatagtctttcattcttttcatagacttttcatagcccatcatggcacaagagtgatata

SEQ ID NO: 427 - DNA, 500 bp, Capsicum chlorosis virus
aattcttttcatagacttttcatagcccatcatggcacaagagtgatatacagatgataagtaattcaagttcccttgaagccaattcattgacacagggaatgtgtttgtttccaaattgtctgttaagacagataaagcagttccgtatgagccatattctgtttgacctctttttagattgaggaagatgtcggttggaatgcaaactcttttaagcttgacatacatcattatacactcacacatcaggtttatttctccggttgttaagatagggttcattataacagctaatatgtacttgtatgtcaaatctgatgccgaccattttgattgatctgctgataagaatgccattttgcattcaaggtttttttggagtgccgtgttataatttgttatagtatcatatgatagcgatgcaaggtttttaatcttataatctccagatattgatattgcctcagaaggatctgcttgggctacatgtttgtatg

SEQ ID NO: 428 - DNA, 500 bp, Capsicum chlorosis virus
agatattgatattgcctcagaaggatctgcttgggctacatgtttgtatgtgtgctcaataaaatacagcatcatctttgtcttcatgctcatgagataaatctctctatccatctttgtcctctgcatcttttcaaacactgaaacaaggaaatctgtatttcctgcattggtcctagacttcatcaaaatgaattcaagtagttgtataaatgttactctattacctttcaatcctcgacccagcttttctaaagcttccagatcaatctctgtaatcttgttgaattctttgatcaaatcatatagctcctcactaaccttttttgatttcagaacagtagttgtcttgaagtagccatatcttactttcataaatgtctccactgtcaatggatgactcttgtagtagaatttgtcctgatttgttttcatcaagactttgttgctgcctgacatcatattagagaaaaaatgaatatattttgattcatccaaac

SEQ ID NO: 429 - DNA, 450 bp, Groundnut bud necrosis virus
ttacaattccagcgaaggaccagcctttgaactcttcttcttagaatgttcaccataatcatccattgagagactggcactgaaagctttgtccatgtatttgacttgttcatcatatttcttgagtgagatagagctggctgttccagggttgctctcactcaatagctttacagctgatttaaacatttcctctagttcatttttgaattcaatctgtgaagcagaaagtactttggctactttgcaaacctgttcataagtagaaaagttcttaattcctaatttctctttcttcacattttgataataagccagagggaatataattggtgccagacctgtcatgctagacaagagaggtagaggacctccaatgcagagcatcatccttaaagcacatgtatcgaaagatgcagggacatttaatccataagctgccactaatgg

SEQ ID NO: 430 - DNA, 431 bp, Groundnut bud necrosis virus
aatgtatcgaaagatgcagggacatttaatccataagctgccactaatggtaattccattattttattgtacatctcctgcttagcagcatcattcttgctcttctcaaccatactagccattttggtcctgatgaaagcttctgtccttttgaaggtccagtcatctggccctacatcagtatttgtagcaacaatagttttaccacaaaaaacatacttaccacttttacaagcagcaaagatctgcttcctgcacttcaaaatattcaaacagtttgtaaaagttatttcaagatttttgttggtgtcatagaaagctttaaagctaaatccgggagtggaatcttctgtttcaatttcaacatctgcagagccaccagccaaaagttctttgattttcttctcggtgagttgcttgacgttagacat

SEQ ID NO: 431 - DNA, 500 bp, Groundnut bud necrosis virus
ggacctagaaatgttcctaattgatcagatttgaatgaacaagtatccatcatcaaccttgctgagaatgtagtatcagacgtgtaagttatattgcaatcaatacctacagcacactgcgaacagcctgaacagatcattttagcttctgaaatgataggttttgttgggatctttttgaacatttctttaggcatatcaacaaccattttgagcttaccaactaagaaatccttctccatgtatagcttgttgctgttctcatccaaatgagacacatcttttgatggagataaaacataaattgcactgtatgtgtaaagtccacattgtttaatattaactttcttgtcacctactgcactacagctccatgtaaaatcattttgagataaagttgctggaacagataaaggaattccatctatagtgatttgaggatgtccaaatgatgaccctgcaaaatcccctaaatcggcaatgttccctgtgagaatttt

SEQ ID NO: 432 - DNA, 550 bp, Groundnut bud necrosis virus
gatgaccctgcaaaatcccctaaatcggcaatgttccctgtgagaattttttgttgtttggttacagcaaataacttatctgtgctcatgtaatcattgtgtaaatcaattgacatgtcaagttgataataatctgtttgtatgggagatctgtctgaatgctttttacaagaatatccatctaatgattttacacaaacttctgcagtgacatggctttcaacaacttgatagatattaaccaaacttgatagatcataaatgtttgtacagtgaccacatattgagccttcatttattgccagacaaccgagttcttcacaaccccaccaagaggttggagtgacacagaaatcaagtactcctactttaggtttctgttttatacaatctgcacacttacctgtgcatgttactagataatcagatactgttgtatcaatttttgcagtagaatatttatacctcacatcatactcaacaccaacactcttgatatatatcataaattccataggagaatgtgttgcatcatcgttaagtagataga

SEQ ID NO: 433 - DNA, 550 bp, Groundnut bud necrosis virus
aagatagcattcatcggtatgatctttagatgctttgtcttgattacaaacacatttttctgtgcaagagtgagttaaaaacgaaaagcatccgcagatcctgcattttaatgggaaatatggccacaaccagttgagtgtccagagaattggatatgtcaaaataccgatcacatcataccagatgcttaaagcatctttagttttccagataaaccatgatatgggaaatgcaaccatcaaaaacacaaaaatccatttgaagtaagaaaagtttgtgcagaagaaaatctttttgggttcatctgaatattttgaaacacagtttctcacaggtatgtctactttagcgatcaggctagatttatcaccacaaagtaaaaaatgattgccatctagttcttcaggtttgaagtttattgttgtgtcaccagcaatagattttatattaccggatttagagcttttcacattctttatcaaaattcctatgttttcttcagaccttaatttgatttgataaggagatgacatagaaacctggttgatt

SEQ ID NO: 434 - DNA, 500 bp, Groundnut bud necrosis virus
tatgtcattttcctcacctggaagcatagagtatatgctaagtgattgaatttgtattgctgcataagcaaatggtattaattcattaggacatccttttctcaaaagcatggttatgtggatagaaagagacattaggtcatcaaaataactattatgtgagctttcagtgctacagttagctaaatgcctacagtataaaggtataactgctccattaatgattctttcagagataaactccacctcagattcagatgcataactctttttaggatttaatgtgatacagtaactcttaaaatgagactggatgcttctgaatagtaactctgataagctagaacaattgaagctggaaaggagtttctttatgtctcccctaactacaatggatgttgcattatcatcagaatgcaccatccatcttattgtaaaatcataatctttcattttctgcatagcttttacataacccatcatggcacaagaatgataga

SEQ ID NO: 435 - DNA, 500 bp, Groundnut bud necrosis virus
aattttctgcatagcttttacataacccatcatggcacaagaatgatagacagatgacaggtagtttaaattcccttgaagccaattcatagacactgggaatgtgtttgtctctaagttatcagccaaaacagacagagcagttccataggatccatattctgtttgacgcctctttagatttagaaaaatgtcagtgggaatgcaaactcttttcaatttcacatacatcattatgcattcacacattaggttgatttcacctgttgttaaaatagggttcatcatgacagccagtatatatttgtaagttaaatctgaagctgaccattttgattggtcggctgacaagaaagccattttacattctagatttttttggagagcagtattgtaattggttatagtgtcatatgataaggatgccaaattctttatcttgtaatctccagagattgagattgcttcagatggatcagattgtgctacatgcttatatg

SEQ ID NO: 436 - DNA, 500 bp, Groundnut bud necrosis virus
agagattgagattgcttcagatggatcagattgtgctacatgcttatatgtatgttctataaaatataacatcatttttgttttcatgctcatgagataaatctctctatccatttttgtcctctgcatcttttcgaacacagaaacaaggaaatctgtgttccctgcattagttcttgatttcatcaagataaactctagcaattggataaatgtcactctattacctttcaatccacgacctaatttttctagagattccagatcaatttctgttatcttattgaattctttgatcaagtcatataattcttcgctaactttctttgacttcagcaccggagttgttttaaaataaccatatcttactttcatgaatgtttctactgttaaaggatgacttttgtaatagaatttgtcctgatttgttttcatgagcaccttgttacttcctgacatcatgttagaaaaaaagtgcagatactttgattcttctagat

SEQ ID NO: 437 - DNA, 500 bp, Pepino mosaic virus
ttaaagttcaggaggtgcatcaattgcgtacatagtgttggcgccgcccatgtgaccacgtgtaacttcaccaagggtggtgatgtaattaccagtggatattttctggcgggcaagggcaccatatttagcaaccgagtgagcagcaagctctttttcattgggctgcctgattaggccatcagcaggctgtagactagctggatttgtgactccatcaaagaagtcaaaagcagcaaacttggtatcttcctgatagcccaattttgcccagttggcaggtggcacattgctgtctaacagtatgttccaaacaatttttgcaaaatacatgcagaattgtctgggtgtgatattgatacgatcaaactgtgcagcaagtgcacgtctagacaaagcagggttggatggtgtggcacctataagttgtgcagattttgaactttgcacatcagcataagcacgagcgaggtcccacatggcaggtccggtctcattgg

SEQ ID NO: 438 - DNA, 500 bp, Pepino mosaic virus
atcagcataagcacgagcgaggtcccacatggcaggtccggtctcattggctgctaaacccatggcagtaaagatcttgccaagggcctcaatttcagcaggcgtggcaactgaagtgacagttgacacgtatttgatcttcttcaaatcacttagggaaggagctgtattaggatttgagaagtcggctgggctctgggcaccagcttgagcagcagttggtggtacatctgatgggttagaagctgtaggttggttttccatagttgagttaaattgtttgaatttaactagataacaaatatgatttcacaattgaggaaaacttaacccgttccaaggggagaagttgattgctttaagaacttcgggtgtgtttggacaatttgttataactatggctgcaccgtcaatgatgacctggcactgattgacctgtttgggttgcagaatgtgtgttgtagcaatgatgctggtgagtattacggctaatgctaaaa

SEQ ID NO: 439 - DNA, 500 bp, Pepino mosaic virus
aatgtgtgttgtagcaatgatgctggtgagtattacggctaatgctaaaactaaatttattggtgaggacaatacccagtgtaagaatgaagataagtatgaggacattaagcttgtttcctgagtgaaagtaggattgttgctgcggaaagtaagaaatcttcttagttccgtcttgatactgaccaccaaagggtagtctgtgcaaattatcacctgcaactggttgataatgactgttttggaagtaaatgcaagctgacagtagaaaggctatagcaatgattttatacgtgtcagtaagatcagctctaggagtcagacctggcatttagttcaccaattgtgagctttgaagtgtgtctagtgagtgaaatgaaggttttagcaggattttcttgaacagcaccagcgagtgtggtacagtagaaagtaacttcactaaactcgagaccagctagttcttcagggcttgtagtctcaacttgatcacctacaaa

SEQ ID NO: 440 - DNA, 500 bp, Pepino mosaic virus
agaccagctagttcttcagggcttgtagtctcaacttgatcacctacaaattccaaaacttctttttctgaagcagaaatgtgttcagaggggtccactgcaaaaggatcaaagtattctactgtgtcgttttgtgctttgactgactcaatgttaagatcaaataacttgtttagtagagcagcagtggatttgccaaatcggtgtgttctgaaggatgtgtagttgggtgttctcaacctttcaatgtaagtgcactgacaggggtcaccaaaaatggctagttttggttcaggaaaactttctaagagatggtactcgtcaacaatgtcacacaaggtatttggaaaacaagaaaggcaaacttgtgaaattttattagctttatctaagtaacaaggcctaggtgaacctataactaagctagggtatgcagaaaataaagtcctaagcaatgtggttttcccagttccagcaattccgtgcacaacaatgattcc

SEQ ID NO: 441 - DNA, 500 bp, Pepino mosaic virus
tgactgtttgttgcataaaagcagctatggtctgaccaggttttgatttgatagctccaagtttttccacttttttcacccattgagactttaggaataatgagatcttattagagtcaaagtcgggtgattgtctacttgccgcattgataagattggccatgggcttggcaagataagtgtttttcacttcagcagcacagatctcccaggtcttttcttcaaagtcaacaggatcggcaggcaagcacatcgcattatggtaattgaagaagagaatgtctccaacatctttcttaagcaaaaattctctgaggtttgcttcaggagttgttatggacaatctagcttcaattgtagcccaaaagagtgtctcgtctttcgcttgttgatgttggaaaagttggaccacagggttctcagtttggattgtgttggagtggccatgatgcttgtcataaatctccctagcaaatttttcaggcaaagcagaagctaat

SEQ ID NO: 442 - DNA, 500 bp, Pepino mosaic virus
gcttgtcataaatctccctagcaaatttttcaggcaaagcagaagctaatttctctaagttatttccatttgctattgggaaatgtgtaacaggtgcttcaggctcagttggactgtcatcagcaggcttagaattgagcatttcagttttttcatctctatagacatcaatgaaggctttgagatatggtgttgcttcaagcttatcccaaaattctgaattgttgggaccagtattgatgaagtggatggaatcaactgcacgagacagacaggtgtacagaactctgtcagagcaatgttgcgtgtggttatcaaggagaatttgtaccttgggtgctgttaaaccttggcaaccagcataggtcatggatttatgtccaatgtctaacatagcactctttttcatttgagatggaactaaaattggcactttgcacttttgtaaggcatgtgaagcaaaagtgattttcaagtgtccttctttctcactgtaaaca

SEQ ID NO: 443 - DNA, 450 bp, Artificial Sequence
  Synthetic Sequence
ttacaattccagcgaaggaccagcctttgaactcttcttcttagaatgttcaccataatcatccattgagagactggcactgaaagctttgtccatgtatttgacttgttcatcatatttcttgagtgagatagagctggctgttccagggttgctctcactcaatagctttacagctgatttaaacatttcctctagttcatttttgaattcaatctgtgaagcagaaagtactttggctactttgcaaacctgttcataagtagaaaagttcttaattcctaatttctctttcttcacattttgataataagccagagggaatataattggtgccagacctgtcatgctggacaagagaggtagaggacctccaatgcagagcatcatccttaaagcacatgtatcgaaagatgcagggacatttaatccataagctgccactaatgg

SEQ ID NO: 444 - DNA, 338 bp, Artificial Sequence
  Synthetic Sequence
ctctccggccgcgcagcggcatccctaccaaaataatcatctgcccattcttgcatctcgtccggaacgttcgtgaacgacgagagtggaaacggaggaacccagggttccggagccttttgaaagagtcgctcgatgttagctttgacgttatggtagcttacaatgaacgtcttggggtctccggcccttataatgttgagagcctctccagcactagctgcattgacggcgttgtggtagacgtcgtctttgtttgattttgtacccccagatactttgtattgtccggattcacaataatcaccttctttggtgatgtaattctggacggcgtt

SEQ ID NO: 445 - DNA, 500 bp, Artificial Sequence
  Synthetic Sequence
ttaaagttcagggggtgcgtcaattgcgtacatggtgttggcgccgcccatgtgaccacgtgtgacttcaccaagggtggtgatgtagttaccagtggatattttttggcgggcaagggcgccgtatttagcaactgagtgagcagcaagttctttttcattgggttgcctgattaggccatcagcaggttgtaggctggctgggtttgtgactccatcgaagaagtcgaaagcagcaaatttggtatcttcttggtagcccagttttgcccagttggcaggtggcatattgctgtctagcagtatgttccagacaatttttgcaaagtacatgcagaattgtctgggtgtgatgttgatacgatcaaattgtgcagcaagtgcacgtctagatagagcagggttggatggtgtggcacctataagttgtgcagattttgaactttgcacatcagcataagcacgagcgaggtcccacatggcaggtccggtctcattgg

SEQ ID NO: 446 - DNA, 350 bp, Artificial Sequence
  Synthetic Sequence
ggtctccatggccgcgcagcggaagatacgacgttctcggcgacccactcttcaagttcatctggaacttgattaaaagaagaagaaagaaatggagaaacataaacttctaaaggaggactaaaaatcctatctaaatttgaacttaaattatgaaattgtaaaatatagtcctttggggccttttcttttaatatattgagggcctcggatttactgcctgaattgagtgcttcggcatatgcgtcgttggcagattgctgacctcctctagctgatctgccatcgatttggaaaactccaaaatcaatgaagtctccgtctttctccacgtaggtcttgacatctgt

SEQ ID NO: 447 - DNA, 428 bp, Artificial Sequence
  Synthetic Sequence
gagtcaaatgaagtaggtacgttcaatccataagctgctactaatggtaattccattacctttgcatacatttcttgcttggcagtttcatttttgcttttttctaccatgttgatcatctttactcttattagagcttctgttctcttaaaagtccaatcttctggaccaaccttagcggctgtggaaacaattgttttttcacagaacttatactttccacttttgcaagcagcaaaaatctgttttctgcattttaagatattcaggcagtttgtgaaagtcatttcaacgcttttgttattatcatagaatgtcttgaagttgaatccaggagttgaatcctcagtttctatttcaacatctgcagttccaccagccaagagttctctaattttcttttcggtaagttgcctgacgttagacat

SEQ ID NO: 448 - DNA, 337 bp, Artificial Sequence
  Synthetic Sequence
catttagaacgtctccatctttggcgatgtagtttttgacgtccgacgctgatttagctccctgaatgttcggatggaaatgtgttgaccgacttggggaaaccaagtcgaagaatctgttatttttgcactggaattttccttcgaattggatgagaacatggatatgcggagacccatcttcgtgaagttctctacagatcttgatgaattttttcttcgtcggggtttctagggtttgcagttgggagagtgcctcttctttagttagagagcactttggatatgtgaggaaatagtttttggcatttactctgaaacgacgtggcggagccat

SEQ ID NO: 449 - DNA, 332 bp, Artificial Sequence; identical to SEQ ID NO: 407
  Synthetic Sequence

SEQ ID NO: 450 - DNA, 351 bp, Artificial Sequence
  Synthetic Sequence
cgcagcggaactccgaccaaaatattcagcaacccaatgttgcatatcctcagggacgttgttaaacgaggatagtggataaggaggagtccatggtataggaggagttgtgaataggcgctcgatgttggcctttatgttatgatagctgacaatgaacgtttttggatcaccagctttgattatgtcgagcgcttctcctgcacttgcagcatttacagcgttatggtagacgtcgtctttatttgcttttgaccctccggaaactttgtactgtccagattcacaataatcgccatcttttgttatgtaatttttaacggcatttgtgtctttggctgcttgaacgtt

SEQ ID NO: 451 - DNA, 450 bp, Artificial Sequence
  Synthetic Sequence
ttaagcaagttctgtgagttttgcctgttttttaaccccgaacatttcatagaacttgttaagagtttcgctgtaatgttccatagcaatacttcctttagcattaggattgctggagctaagtatagcagcatactctttccccttcttcacctgatcttcattcatttcaaatgctttgcttttcagcacagtgcaaacttttcctaaggcttccttggtgtcatacttctttgggtcgatcccgaggtccttgtattttgcatcctgatatatagccaagacaacactgatcatctcaaagctatcaactgaagcaataagaggtaagctacctcctagcattatggcaagtctcacagactttgcatcatcgagaggtaatccataggcttgaatcaaagggtgggaagcaatcttagatttgatagtattgagattctcggaatt

SEQ ID NO: 452 - DNA, 852 bp, Artificial Sequence
  Synthetic Sequence: fused viral sequences for dsRNA production
tgggacccacttctaaatgaatttcctgaatctgttcacggatttcgttgtatgttagctattaaatatttgcagtccgttgaggaaacttacgagcccaatacattgggccacgatttaattagggatcttatatctgttgtaagggcccgtgacttgtcgaagcgaccaggcgatataatcatttccacgcccgcctcgaaggttcgccgaaggctgaacttcgacagcccatacagcaaccgtgctgctgtccccattgcccaaggcacaaacaagcgacgatcatggacgtacaggccgatgaacagaaaacccagaatatacagaatgtatcgaagccccgacgttccccgtggatgtgaaggcccatgtaaagtgcagtcctttgaacctaggcacgatatctctcacactggcaaagtcatgtgtgttagtgatgttacccgaggaactggactcacacaccgcgtagggaagcgattctgtgtgaaatccatctatgtgcatatggatggacgagaacatcaagctgaagaaccacacgaacagcgtcatgttctggctagtgagagaccgtagaccctatggtacgcctatggatttcggccaggtgttcaacatgtatgacaacgagcccagcaccgccaccgtgaagaacgatctacgcgatcgtttccaagtcatgcacaagttctcggccaaggtcacaggtggacagtatgccagcaacgagcaagccttagtcaagcgtttctggaaggtgaacaaccacgttgtgtacaaccaccaagaagctgggaaatacgagaaccacacggagaacgcgctgctattgtatatggcatgtac

SEQ ID NO: 453 - DNA, 919 bp, Artificial Sequence
  Synthetic Sequence: fused viral sequences for dsRNA production
aagactttttgtctggaaaacctcgaccagatcaaaaagatgagcattatttcatgtctgacattcctaaagaatcgtcagagcataatgaaggttattaagcaaaggattttacttttggtaaaattaccacaaagaaaacttcagacaggattggagccactgacatgaccttcagaaggcttgatagcttgatcagggtcaggcttgttgaagaaactgggaattccgagaatctcaatactatcaaatctaagattgcttcccaccctttgattcaagcctatggattacctctcgatgatgcaaagtctgtgagacttgccataatgctaggaggtagcttacctcttattgcttcagttgatagctttgagatgatcagtgttgtcttggctatatatcaggatgcaaaatacaaggacctcgggatcgacccaaagaagtatgacaccatttgacttcttcgatggagtcaccaaccctgccagcctacaacctgctgatggcctcatcaggcaacccaatgaaaaagaacttgctgctcactcagttgctaaatacggcgccctagccaggcaaaaaatctccactggcaactacatcaccacccttggtgaagttacacgtggacacatgggcggagccaacaccatgtacgcaatcgacgcaccccctgaactttaatgtctaacgtcaagcaactcaccgagaagaaaatcaaagaactcttggctggtggaactgcagatgttgaaattgaaactgaagattcaactcccggattcagcttcaaaactttctatgacactaacaaaaaccttgaaataactttcacaaactgcctgaatattttaaagtgcagaaagcagatctttgctgcttgcaaaagtggtaagtatattttctgtgataaaac

SEQ ID NO: 454 - DNA, 860 bp, Artificial Sequence
  Synthetic Sequence: fused viral sequences for dsRNA production
cctcgtttatttaaaatatatgccaaaaattatttcctaacatatcccaattgttctctctctaaagaggaagcactttcccaattaaaaaacctagaaaccccaacaaataaaaaatacatcaaagtttgcaaagaactccacgagaatggggaaccacatctccacatgctcatccaattcgaaggcaaataccaatgcaaaaaccaacgatccttcgacctggtatccccaaacagatcaacacatttccatccaaacattcaggcagctaagagctcaacagacgtcaaaacctacatggaaaaagacggaaactccattgaatggggtgtttcccaaatcgatagacgatctgcccgtggtggtcaacaaacagccaacgacgcatacgcccaagcaattaacacaggaaataaagacgacgcactaaaagtactaaaagaactagccccaaaagattacgttctgcaatttcacaatttaaataccaatttagatcgtcgttcacgaacgttccggacgagatgcaagaatgggcagatgattattttggtagggatgccgctgcgcggccggagagacctataagtataatcatcgagggtgaatcgaggacaggcaaaacaatatgggcacgtacactaggcccacacaattacttaagcggtcaccttgatctcaacgcaaaaatctactcaaacaatgcagagtataacgtcattgatgacatcacgctcgcattatgttaaacactttaaagagcttatgggggcccaacaagactggcaatcaaactgcaaatacggcaaaccaattcaaattaaaggcgggatacccactatctttctttgcaatcc

SEQ ID NO: 455 - DNA, 369 bp, Artificial Sequence
  Synthetic Sequence: fused tospovirus genome terminal sequences
agagcaatcgagcaacaaattaaagtattctaaactcagtttcaatattaataagaaatactatttctgacactaatgtctggtttagaacttgcaactagactgcatcctattatgatgcaatctgtttttaaaccttttccaagaattatacaattggcagctttgcgctcttttcttgttttagaatctgtactaaatattctattatcggttattatactattgcccataaattatttacattagagcaatcggtgcgtcaattactagataaaatcatcaaataataaacaagaaataagagcaatcggggcatctaataattctagaaaaacaacgatatactcaagaaatactatttcaggc

What is claimed is:

1. A tomato plant comprising resistance to a plurality of plant virus species, wherein the resistance is provided by virus-derived sequences with at least two different modes of action selected from the group consisting of a dsRNA or miRNA being complementary to all or part of a target gene of said plant virus species, and inhibition of tospovirus virion assembly, wherein resistance provided to at least one of the plant virus species is provided by expression of a *tospovirus* genome segment terminal repeat sequence which inhibits tospovirus virion assembly.

2. The plant of claim 1, wherein resistance provided to at least one of the plant virus species is provided by inhibiting *tospovirus* virion assembly, wherein *tospovirus* virion assembly is inhibited by a sequence comprised within a nucleic acid construct comprising a first nucleic acid segment and a second nucleic acid segment, wherein the first and second segments are substantially inverted repeats of each other and are linked together by a third nucleic acid segment, and wherein the third segment comprises at least one terminal repeat sequence of a tospovirus genome segment that inhibits tospovirus virion assembly.

3. The plant of claim 2, wherein the third nucleic acid comprises a tospovirus genome terminal repeat sequence comprising one of: a terminal repeat sequence of CaCV or GBNV L genome segment, a terminal repeat sequence of CaCV or GBNV M genome segment, a terminal repeat sequence of a CaCV or GBNV S genome segment, a nucleic acid sequence comprising SEQ ID NO: 167, a nucleic acid sequence comprising SEQ ID NO: 168, a nucleic acid sequence comprising SEQ ID NO: 376, a nucleic acid sequence comprising SEQ ID NO: 377, a nucleic acid sequence comprising SEQ ID NO: 378, or a nucleic acid sequence comprising SEQ ID NO: 455.

4. The plant of claim 3, wherein the tospovirus genome segment terminal repeat sequence comprises SEQ ID NO:167 or SEQ ID NO:168.

5. A method for conferring resistance in a tomato plant to a plurality of plant virus species, the method comprising expressing in the plant at least two virus-derived nucleic acid sequences that collectively provide resistance to said plurality of plant virus species, wherein at least 2 different modes of action are utilized to provide such resistance, comprising expression of at least two sequences selected from the group consisting of: a dsRNA or miRNA being complementary to all or part of a target gene of said plant virus species, and a sequence which interferes with tospovirus virion assembly, wherein resistance provided to at least one of the plant virus species is provided by expression of a tospovirus genome segment terminal repeat sequence that inhibits tospovirus virion assembly.

6. The method of claim 5, wherein the resistance comprises resistance against a *begomovirus,* or *potexvirus.*

7. The method of claim 5, wherein resistance provided to at least one of the plant virus species is provided by expression of a nucleic acid construct that produces dsRNA.

8. The method of claim 5, wherein resistance provided to at least one of the plant virus species is provided by expression of a dsRNA fusion construct.

9. The method of claim 7, wherein the dsRNA interferes with expression of a virus coat protein gene, a virus movement protein gene or a virus replication gene.

10. The method of claim 7, wherein the nucleic acid construct comprises SEQ ID NO:443.

11. The method of claim 5, wherein resistance provided to at least one of the plant virus species is provided by expression of a nucleic acid construct that produces miRNA.

12. The method of claim 11, wherein resistance against a begomovirus or tospovirus is provided by a sequence encoded by a stacked miRNA expression cassette.

13. The method of claim 11, wherein the miRNA interferes with expression of a virus coat protein gene, a virus movement protein gene or a virus replication gene.

14. The method of claim 11, wherein the miRNA comprises SEQ ID NO: 7.

15. The method of claim 5, wherein:
(a) resistance against a begomovirus is provided by expression of dsRNA which interferes with expression of a begomovirus replication gene;
(b) resistance against a tospovirus or potexvirus is provided by expression of a dsRNA which interferes with expression of a virus coat protein gene or virus movement protein gene;
(c) resistance against a potexvirus is provided by expression of a nucleic acid construct which produces miRNA; or
(d) resistance against a begomovirus or tospovirus is provided by a sequence encoded by a stacked miRNA expression cassette.

16. The method of claim 5, wherein resistance provided to at least one of said plant virus species is provided by inhibiting *tospovirus* virion assembly, wherein *tospovirus* virion assembly is inhibited by a sequence comprised within a nucleic acid construct comprising a first nucleic acid segment and a second nucleic acid segment, wherein the first and second segments are substantially inverted repeats of each other and are linked together by a third nucleic acid segment, and wherein the third segment comprises at least one terminal repeat sequence of a *tospovirus* genome segment, expression of which inhibits tospovirus virion assembly.

17. The method of claim 16, wherein the third nucleic acid comprises a tospovirus genome terminal repeat sequence comprising one selected from the group consisting of: a terminal repeat sequence of CaCV or GBNV L genome segment, a terminal repeat sequence of CaCV or GBNV M genome segment, and/or a terminal repeat sequence of a CaCV or GBNV S genome segment.

18. The method of claim 17, wherein the tospovirus genome terminal repeat sequence comprises SEQ ID NO: 167, SEQ ID NO: 168, SEQ ID NO: 376, SEQ ID NO: 377, or SEQ ID NO: 378.

* * * * *

UNITED STATES PATENT AND TRADEMARK OFFICE
CERTIFICATE OF CORRECTION

PATENT NO. : 8,455,716 B2
APPLICATION NO. : 12/763790
DATED : June 4, 2013
INVENTOR(S) : Shihshieh Huang et al.

Page 1 of 1

It is certified that error appears in the above-identified patent and that said Letters Patent is hereby corrected as shown below:

In the Claims:

Claim 3, Column 43, Line 39, delete "of CaCV", and insert --of a CaCV--

Claim 3, Column 43, Line 40, delete "of CaCV", and insert --of a CaCV--

Claim 17, Column 44, Line 66, delete "of CaCV", and insert --of a CaCV--

Claim 17, Column 44, Line 67, delete "of CaCV", and insert --of a CaCV--

Signed and Sealed this
Thirteenth Day of August, 2013

Teresa Stanek Rea
*Acting Director of the United States Patent and Trademark Office*